US008357527B2

(12) United States Patent
Ubersax

(10) Patent No.: US 8,357,527 B2
(45) Date of Patent: Jan. 22, 2013

(54) METHOD FOR GENERATING A GENETICALLY MODIFIED MICROBE

(75) Inventor: Jeffrey A. Ubersax, Emeryville, CA (US)

(73) Assignee: Amyris, Inc., Emeryville, CA (US)

(*) Notice: Subject to any disclaimer, the term of this patent is extended or adjusted under 35 U.S.C. 154(b) by 325 days.

(21) Appl. No.: 12/791,717

(22) Filed: Jun. 1, 2010

(65) Prior Publication Data
US 2010/0304490 A1 Dec. 2, 2010

Related U.S. Application Data

(60) Provisional application No. 61/183,031, filed on Jun. 1, 2009.

(51) Int. Cl.
C12N 1/00 (2006.01)
C12N 1/19 (2006.01)

(52) U.S. Cl. .................. 435/255.1; 435/254.2

(58) Field of Classification Search .............. None
See application file for complete search history.

(56) References Cited

U.S. PATENT DOCUMENTS

2002/0049544 A1* 4/2002 Nislow et al. ............. 702/19
2004/0005678 A1 1/2004 Keasling et al.
2010/0311065 A1 12/2010 Ubersax et al.

FOREIGN PATENT DOCUMENTS

| WO | WO 2006/014837 A1 | 2/2006 |
| WO | WO 2006/024892 A1 | 3/2006 |
| WO | WO 2007/024718 A2 | 3/2007 |
| WO | WO 2009/042070 A2 | 4/2009 |

OTHER PUBLICATIONS

ISA/EP, PCT International Search Report & Written Opinion of the International Searching Authority dated Aug. 19, 2010, in International Application No. PCT/US2010/036861, filed Jan. 6, 2010.
Database UniProt [Online], "SubName: Full=YJL213Wp-like protein," XP-002594695 dated Nov. 25, 2008 retrieved from EBI accession No. UNIPROT:B5VKX8.
Database EMBL [Online], "Sequence 80275 from Patent WO2006024892," XP-002594696 dated May 26, 2009 retrieved from EBI accession No. EM_PAT:HA288834.
Database EMBL [Online], "*Saccharomyces pastorianus* mRNA. clone: D042-34, 5' end sequence, expressed during fermentation," XP-002594697 dated Jun. 29, 2007 retrieved from EBI accession No. EM_EST:C.J997310.
Database UniProt [Online], "SubName: Full—Putative uncharacterized protein," XP-002602030 dated Oct. 13, 2009 retrieved from EB1 accession No. UNIPROT:C7GUD8.
Database UniProt [Online], "SubName: Full=Putative uncharacterized protein," XP-00260203 1 dated Oct. 13, 2009 retrieved from EBI accession No. UNIPROT:C7GUE1.
Akada, "Genetically Modified Industrial Yeast Ready for Application,"*J. of Biosei. & Bioeng.*, Aug. 2002, 94(6):536-44.
Atcheson et al., "Isolation, DNA sequence, and regulation of a meiosis-specific eukaryotic recombination gene," *Proc. Natl. Acad. Set. USA*, Nov. 1987, 84(22):8035-39.
Basso et al., "Yeast selection for fuel ethanol production in Brazil," *Ferns Yeast Research*, 2008, 8(7):1155-63.
Botstein et al., "Sterile Host Yeasts (SHY): A Eukaryotic System of Biological Containment for Recombinant DNA Experiments," *Gene*, 1979, 8(1):17-24.
Bowman et al., "The nucleotide sequence of *Saccharomyces cerevisiae* chromosome XIII," *Nature*, May 29, 1997, 387(6632 Supp.):90-93.
Dujon et al., "The nucleotide sequence of *Saccharomyces cerevisiae* chromosome XV," *Nature*, May 29, 1997, 387(6632 Supp.):98-102.
Galibert et al., "Complete nucleotide sequence of *Saccharomyces cerevisiae* chromosome X," *EMBO J.*, 1996, 15(9):2031-49.
Goffeau et al., "Life with 6000 Genes," *Science*, Oct. 25, 1996, 274(5287):546, 563-67.
Good et al., "The Ste5 Scaffold Directs Mating Signaling by Catalytically Unlocking the Fus3 MAP Kinase for Activation," *Cell*, Mar. 20, 2009, 136(6):1085-97; & "Supplemental Experimental Procedures," *Cell*, Mar. 20, 2009, 136(Supp. Data).
Govender etal., "Controlled Expression of the Dominant Flocculation Genes *FLO1, FLO5*, and *FLO11* in *Saccharomyces cerevisiae*," *Appl. Environ. Microbiol.*, Oct. 2008, 74(19):6041-52.
Hadfield et al., "G418-resistance as a dominant marker and reporter for gene expression in *Saccharomyces cerevisiae*," *Curr. Genet.*, 1990, 18(4):303-13.
Hasty et al., "The Length of Homology Required for Gene Targeting in Embryonic Stem Cells," *Mol. & Cell. Biol.*, Nov. 1991, 11(11):5586-91.
Johnston et al., "The nucleotide sequence of *Saccharomyces cerevisiae* chromosome XII," *Nature*, May 29, 1997, 387(6632 Supp.):87-90.
Leu et al., "The Meiosis-Specific Hop2 Protein of *S. cerevisiae* Ensures Synapsis between Homologous Chromosomes," *Cell*, Aug. 7, 1998, 94(3):375-86.
Mukal et al., "Function ofthe Ste Signal Transduction Pathway for Mating Pheromones Sustains *MAT-α-1* Transcription in *Saccharomyces cerevisiae*," *Mol. & Cell. Biol.*, Apr. 1993, 13(4):2050-60.
Nevoigt, "Progress in Metabolic Engineering of *Saccharomyces cerevisiae*," *Microbiology and Mol. Biol. Reviews*, Sep. 2008, 72(3):379-412.
Pechous etal., "Cloning and functional expression of an ( *E, E*)-α-farnesene synthase cDNA from peel tissue of apple fruit," *Planta*, 2004. 219(1):84-94.
Picaud et al., "Expression, purification and characterization of recombinant (*E*)-β-farnesene synthase from *Artemisia annua*," *Phytochemistry*, 2005, 66(9):961-967.

(Continued)

*Primary Examiner* — Michele K Joike
(74) *Attorney, Agent, or Firm* — Squire Sanders (US) LLP

(57) ABSTRACT

Provided herein are methods of generating genetically modified microorganisms, e.g., genetically modified yeast strains, which comprise functional disruptions in one or more pheromone response genes and one or more sporulation genes, and genetically modified yeast cells, e.g., genetically modified diploid and haploid yeast cells, that lack sporulation capability and endogenous mating capability, produced thereby.

18 Claims, 11 Drawing Sheets

OTHER PUBLICATIONS

Ramirez et al., "Construction of Sterile imelΔ-Transgenic *Saccharomyces cerevisiae* Wine Yeasts Unable To Disseminate in Nature," *Applied & Environmental Microbiology*, Apr. 2008, 74(7):2129-34.

Russell et al., "Structure of the *Saccharomyces cerevisiae HO* Gene and Analysis of Its Upstream Regulatory Region," *Mol. & Cell. Biol.*, Dec. 1986, 6(12):4281-94.

Smith et al, Role of *IME1* Expression in Regulation of Meiosis in *Saccharomyces cerevisiae*, *Mol. & Cell. Biol.*, Dec. 1990, 10(12):6103-13.

Song, Linsheng, "A Soluble Form of Phosphatase in *Saccharomyces cerevisiae* Capable of Converting Farnesyl Diphosphate Into *E,E*-Farnesol,"*Appl. Biochem. Biotechnol.*, 2006, 128:149-57.

Teague et al., Nucleotide sequence of the yeast regulatory gene *STE7* predicts a protein homologous to protein kinases, *Proc. Natl. Acad. Sci. USA*, Oct. 1986, 83(19):7371-75.

Tettelin et al., "The nucleotide sequence of *Saccharomyces cerevisiae* chromosome VII," *Nature*, May 29, 1997, 387(6632 Supp.):81-84.

Wang, et al., "Construction of a flocculating yeast for fuel ethanol production," *Biotechnol. Lett.*, 2008, 30(1):97-102; published online Sep. 22, 2007.

Yoshida, et al., "Identification of bottom-fermenting yeast genes expressed during lager beer fermentation," *Yeast*, 2007, 24(7):599-606.

International Preliminary Report for PCT/US2010/036861, mailed Sep. 6, 2011, 16 pgs.

Response on Mar. 29, 2011, 7 pgs. to Written Opinion for PCT/US2010/036861, mailed Aug. 19, 2010.

* cited by examiner

METHOD FOR GENERATING A GENETICALLY MODIFIED MICROBE

This application claims benefit under 35 U.S.C. §119(e) of U.S. Provisional Application No. 61/183,031, filed Jun. 1, 2009, which is hereby incorporated by reference in its entirety.

FIELD OF THE INVENTION

The methods and compositions provided herein generally relate to the industrial use of microorganisms such as yeast. Provided herein are genetically modified microorganisms that are modified to significantly reduce the risk of their dissemination in nature, and in particular, dissemination in nature of their recombinant DNA sequences. Also provided are methods for making and using such genetically modified microorganisms.

BACKGROUND

Advances in recombinant DNA technology have allowed for the production of industrially useful substances in large amounts through the utilization of prokaryotes or eukaryotes. Among eukaryotes, yeasts (in particular, yeasts belonging to the genus *Saccharomyces*), have been widely used for the production of fermented products. Generally, yeasts can grow rapidly and can be cultivated at higher density as compared with bacteria, and do not require an aseptic environment in the industrial setting. Furthermore, yeast cells can be easily separated from culture medium as compared with bacteria, greatly simplifying the process for product extraction and purification. Because of these characteristics, yeasts (in particular, genetically modified yeasts harboring recombinant DNA sequences) have been employed as hosts for the production of useful products, and the utility of such yeasts has been established. However, the use of genetically modified yeasts in industry carries a potential environmental risk, because the dispersal of such yeasts, and/or the recombinant DNA sequences contained in such yeasts, may have unpredictable consequences on the ecosystem. Thus, there exists a need for yeasts that are suitable for industrial applications but pose a reduced risk of being disseminated and propagated in nature, and in particular, pose a reduced risk of disseminating their recombinant DNA sequences in nature.

SUMMARY OF THE INVENTION

Provided herein are methods for generating genetically modified microorganisms, e.g., genetically modified yeast strains, that are sporulation and/or endogenous mating impaired. The methods provided herein comprise functionally disrupting one or more sporulation genes and/or one or more pheromone response genes in genetically modified haploid microbial cells, e.g., yeast cells, and inducing said genetically modified haploid microbial cells to form stable diploids that are effectively sexually sterile and constrained to the diploid state of their life cycle due to their lack of sporulation and/or mating capability. Microorganisms, e.g., yeast strains, genetically modified in accordance with the methods provided herein find use in industrial applications, e.g., industrial fermentation applications, and can provide the advantage of posing a significantly reduced risk of being disseminated and propagated in nature through mating with wild-type microorganisms.

In one aspect, provided herein is a genetically modified yeast cell comprising: a functional disruption in one or more sporulation genes, wherein said yeast cell lacks sporulation capability as a result of said disruption of the one or more sporulation genes; a functional disruption in one or more pheromone response genes, wherein said yeast cell lacks endogenous mating capability as a result of said disruption of the one or more pheromone response genes; and one or more integrated heterologous nucleotide sequences of interest. In some embodiments, the genetically modified yeast cell is heterothallic (ho). In some embodiments, the genetically modified yeast cell is a diploid cell in which both copies of one or more sporulation genes and/or both copies of one or more pheromone response genes are functionally disrupted. In some embodiments, the genetically modified diploid cell is homozygous other than for its mating type allele. In some embodiments, the genetically modified yeast cell is a haploid cell. In some embodiments, the genetically modified haploid cell further comprises a recombinant plasmid encoding a homothallism (HO) protein. In some embodiments, the genetically modified haploid cell comprises one or more recombinant plasmids encoding the one or more pheromone response genes that is functionally disrupted in said yeast cell.

In some embodiments, the genetically modified yeast cell useful for the practice of the methods provided herein is a *Saccharomyces cerevisiae* cell. In some embodiments, the *Saccharomyces cerevisiae* cell is of the Baker's yeast, Mauri, Santa Fe, CBS 7959, CBS 7960, CBS 7961, CBS 7962, CBS 7963, CBS 7964, IZ-1904, TA, BG-1, CR-1, SA-1, M-26, Y-904, PE-2, PE-5, VR-1, BR-1, BR-2, ME-2, VR-2, MA-3, MA-4, CAT-1, CB-1, NR-1, BT-1 or AL-1 strain. In particular embodiments, the *Saccharomyces cerevisiae* cell is of the PE-2 strain. In other particular embodiments, the *Saccharomyces cerevisiae* cell is of the CAT-1 strain.

In some embodiments, the one or more sporulation genes disrupted in the genetically modified yeast cell is selected from the group consisting of IME1, IME2, NDT80, SPO11, SPO20, AMA1, HOP2, and SPO21. In particular embodiments, the IME1 gene is disrupted. In some embodiments, the one or more pheromone response genes disrupted in the genetically modified yeast cell is selected from the group consisting of STE5, STE4, STE18, STE12, STE7, and STE11. In particular embodiments, the STE5 gene is disrupted. In particular embodiments, the genetically modified yeast cell comprises a functional disruption of both the STE5 and IME1 gene. In some embodiments, a haploid cell of the genetically modified yeast cell comprises a functional disruption of the STE5 gene and a recombinant plasmid encoding a STE5 protein.

In another aspect, provided herein is a method for generating a diploid yeast strain having impaired sporulation and mating capabilities. In some embodiments, the method comprises: (a) obtaining a first genetically modified haploid yeast cell, wherein the first genetically modified haploid yeast cell is sporulation and endogenous mating impaired and comprises a chromosomally integrated heterologous nucleotide sequence encoding a protein of interest; (b) obtaining a second genetically modified haploid yeast cell, wherein the second genetically modified haploid yeast cell is sporulation and endogenous mating impaired, of the opposite mating type as the first genetically modified haploid yeast cell, and comprises a chromosomally integrated heterologous nucleotide sequence encoding said protein of interest; (c) transforming each of the first and second genetically modified haploid yeast cells with one or more plasmids encoding a protein capable of complementing the endogenous mating impairment of said first and second genetically modified haploid yeast cells; (d) mating the first genetically modified haploid yeast cell with the second genetically modified haploid yeast cell, thereby forming a genetically modified diploid yeast cell; and (e) eliminating the one or more plasmids from the genetically modified diploid yeast cell, wherein the resulting genetically modified diploid yeast cell is sporulation and endogenous mating impaired.

In some embodiments, the first genetically modified haploid yeast cell and the second genetically modified haploid yeast cell are endogenous mating impaired due to a functional disruption of one or more pheromone response genes. In some such embodiments, step (c) comprises transforming each of the first and second genetically modified haploid yeast cells with one or more plasmids encoding a functional copy of the pheromone response gene that is functionally disrupted in said first and second genetically modified haploid yeast cells. In some embodiments, the one or more pheromone response genes is selected from the group consisting of STE5, STE4, STE18, STE12, STE7, and STE11. In certain embodiments, the first genetically modified haploid yeast cell and the second genetically modified haploid yeast cell are endogenous mating impaired due to a functional disruption of the STE5 gene.

In some embodiments, the first genetically modified haploid yeast cell and the second genetically modified haploid yeast cell is sporulation impaired due to a functional disruption of one or more sporulation genes. In some such embodiments, the one or more sporulation genes is selected from the group consisting of IME1, IME2, NDT80, SPO11, SPO20, AMA1, HOP2, and SPO21. In some embodiments, the first genetically modified haploid yeast cell and the second genetically modified haploid yeast cell is sporulation impaired due to a functional disruption of the IME1 gene. In particular embodiments, the first genetically modified haploid yeast cell and the second genetically modified haploid yeast cell are mating impaired due to a functional disruption of the STE5 gene, and are sporulation impaired due to a functional disruption of the IME1 gene.

In some embodiments, the second genetically modified haploid yeast cell is obtained by inducing a mating type switch in a population of the first genetically modified haploid yeast cell. In some such embodiments, the first genetically modified haploid yeast cell is heterothallic (ho), and said population is induced to switch mating type by transforming the genetically modified haploid yeast cell with a recombinant plasmid encoding a homothallism (HO) protein, wherein expression of the HO protein induces a mating type switch of the genetically modified haploid yeast cell.

In other embodiments, the second genetically modified haploid yeast cell is obtained by changing the mating type locus in the first genetically modified haploid yeast cell using recombinant DNA technology. In some embodiments, the first genetically modified haploid yeast cell is transformed with an integration construct that comprises as an integrating sequence a nucleotide sequence that encodes a mating type other than the mating type of the first genetically modified haploid yeast cell, flanked by homologous sequences that are homologous to nucleotide sequences that flank the mating type locus in the first genetically modified haploid yeast cell. Upon integration of the integrating sequence via homologous recombination the mating type locus of the first genetically modified haploid yeast cell is replaced by the mating type locus encoded by the inserting sequence, resulting in the generation of the second genetically modified haploid yeast cell. In some embodiments, the integration construct is used to switch the mating type of the first genetically modified haploid yeast cell from a to alpha using an integration construct encoding the alpha mating type (MAT alpha). In some embodiments, the integration construct comprises SEQ ID NO: 155. In other embodiments, the integration construct is used to switch the mating type of the first genetically modified haploid yeast cell from alpha to a using an integration construct encoding the a mating type (MAT A). In some embodiments, the integration construct comprises SEQ ID NO: 156.

In another aspect, provided herein is a method for generating a sporulation and endogenous mating impaired heterothallic (ho) diploid yeast cell, the method comprising: (a) obtaining a first genetically modified heterothallic haploid yeast cell, wherein the first genetically modified heterothallic haploid yeast cell comprises: (i) a chromosomally integrated heterologous nucleotide sequence encoding a protein of interest; and (ii) functional disruptions in the STE5 gene and the IME1 gene; (b) transforming a population of the first genetically modified heterothallic haploid yeast cell with a plasmid comprising a polynucleotide encoding a homothallism (HO) protein, wherein expression of the HO protein induces a mating-type switch of the first genetically modified heterothallic haploid yeast cell, whereby a second genetically modified heterothallic haploid yeast cell is obtained, wherein the second genetically modified haploid yeast cell is of the opposite mating type as the first genetically modified haploid yeast cell, and comprises: (i) a chromosomally integrated heterologous nucleotide sequence encoding said protein of interest; and (ii) functional disruptions in the STE5 gene and the IME1 gene; (c) transforming each of the first and second genetically modified heterothallic haploid yeast cells with a plasmid encoding a STE5 gene; (d) mating the first genetically modified haploid yeast cell with the second genetically modified haploid yeast cell, thereby forming a genetically modified diploid yeast cell; and (e) eliminating any plasmids from the genetically modified diploid yeast cell, wherein the resulting genetically modified heterothallic diploid yeast cell is sporulation and endogenous mating impaired.

Also provided herein is a genetically modified heterothallic (ho) yeast cell that lacks sporulation and endogenous mating capability generated by the present methods.

Also provided herein is a MATα/a ste5/ste5ime1/ime1 yeast cell.

Figure 1:
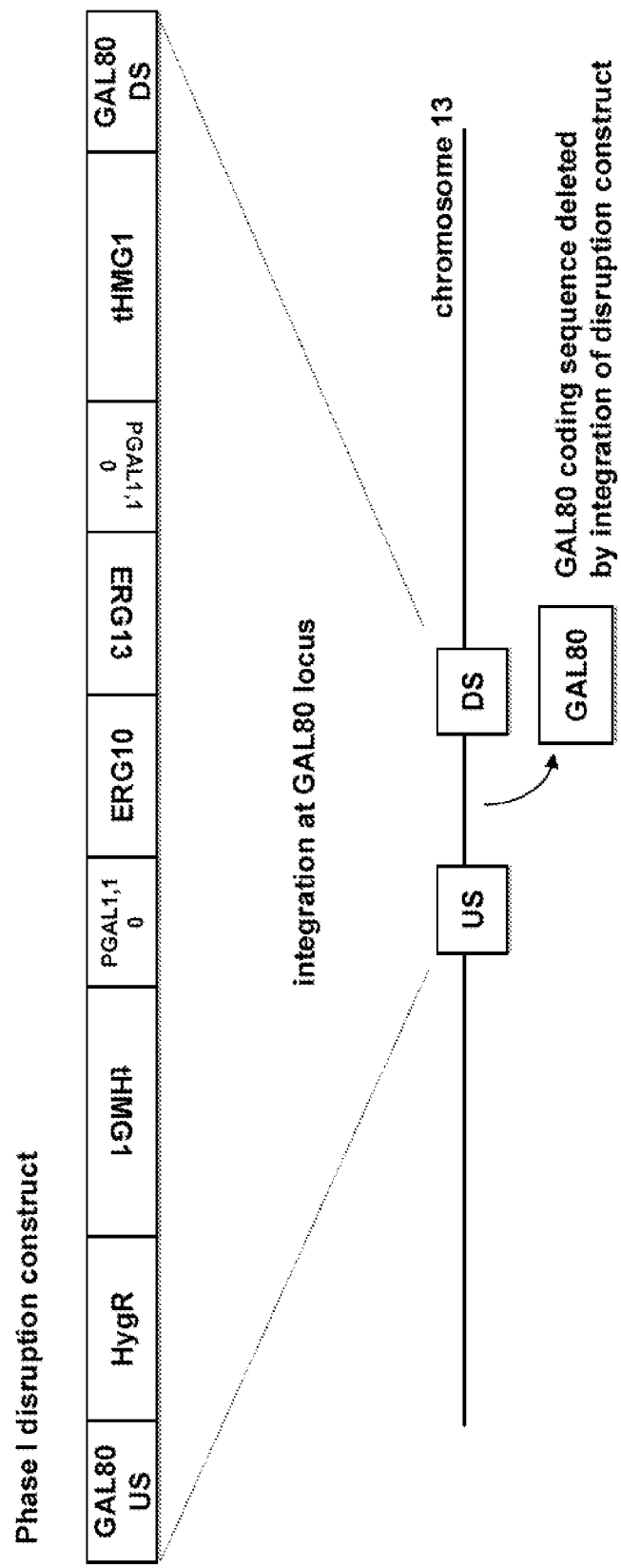
FIG. 1 provides the structure of the Phase I disruption construct and of the target locus after integration of the disrupting sequence by homologous recombination.

DETAILED DESCRIPTION OF THE EMBODIMENTS 5.1 Terminology

As used herein, the term "heterologous" refers to what is not normally found in nature. The term "heterologous nucleotide sequence" refers to a nucleotide sequence not normally found in a given cell in nature. As such, a heterologous nucleotide sequence may be: (a) foreign to its host cell (i.e., is "exogenous" to the cell); (b) naturally found in the host cell (i.e., "endogenous") but present at an unnatural quantity in the cell (i.e., greater or lesser quantity than naturally found in the host cell); or (c) be naturally found in the host cell but positioned outside of its natural locus.

As used herein, to "functionally disrupt" or a "functional disruption" of a target gene, e.g., a pheromone response gene or a sporulation gene, means that the target gene is altered in such a way as to decrease in the host cell the activity of the protein encoded by the target gene. In some embodiments, the activity of the protein encoded by the target gene is eliminated in the host cell. In other embodiments, the activity of the protein encoded by the target gene is decreased in the host cell. Functional disruption of the target gene may be achieved by deleting all or a part of the gene so that gene expression is eliminated or reduced, or so that the activity of the gene product is eliminated or reduced. Functional disruption of the target gene may also be achieved by mutating a regulatory element of the gene, e.g., the promoter of the gene so that expression is eliminated or reduced, or by mutating the coding sequence of the gene so that the activity of the gene product is eliminated or reduced. In some embodiments, functional disruption of the target gene results in the removal of the complete open reading frame of the target gene.

As used herein, "endogenous mating" and "endogenous mating capability" refer to the ability of haploid microbial cells of opposite mating types, i.e. mating types a and α, to form a diploid cell in the absence of heterologous gene expression, e.g., expression of a heterologous copy of a pheromone response gene or of any gene capable of inducing mating among such haploids.

As used herein, "endogenous mating impaired" refers to a reduction in the endogenous mating capability of a microbial cell sufficient to inhibit mating within a population of haploids of such a microbial cell, relative to a population of wild-type haploid microbial cells. In some embodiments, inhibition comprises a reduction of at least 10%, 20%, 30%, 40%, 50%, 60%, 65%, 70%, 75% 80%, 85%, 90%, or 95% in the mating rate of a population of haploid microbial cells relative to the mating rate of a population of wild-type haploid microbial cells.

As used herein, "sporulation impaired" refers to a reduction in the sporulation activity of a diploid microbial cell sufficient to inhibit sporulation within a population of diploids of such a microbial cell, relative to a population of wild-type diploid microbial cells. In some embodiments, inhibition comprises a reduction of at least 10%, 20%, 30%, 40%, 50%, 60%, 65%, 70%, 75% 80%, 85%, 90%, or 95% in the sporulation rate of a population of diploid microbial cells relative to the sporulation rate of a population of wild-type diploid microbial cells.

As used herein, the term "complementing" in the context of a gene refers to a gene that has the facility to replace the function of a functionally disrupted gene, e.g., a functionally disrupted sporulation or pheromone response gene. In some embodiments, the mechanism of function between the complementing gene and the disrupted gene need not be identical. In some embodiments, a target gene, e.g., a sporulation gene or a pheromone response gene, that has been functionally disrupted can be complemented by a heterologous gene that either produces a protein homologous to the protein encoded by the disrupted gene or a protein that provides a phenotype that permits, for example, sporulation or mating by an alternative mechanism.

5.2 Genetically Modified Microbes and Methods for Making the Same

Provided herein are compositions comprising a genetically modified microbe, for example, a genetically modified yeast cell (e.g., a genetically modified *Saccharomyces cerevisiae* cell), that is functionally impaired in its sporulation and/or endogenous mating capability, and methods and materials for generating such compositions. The methods provided herein interrupt the sexual reproductive cycle of the microbe to minimize the dissemination of the microbe in nature and to minimize the likelihood of an exchange of genetic material between the genetically modified microbe and a wild-type microbe that is not compromised in its ability to disseminate in nature.

Many fungal cells, e.g., yeast cells, can reproduce both sexually and asexually. Asexual reproduction involves only one parent cell and enables rapid population growth. In contrast, sexual reproduction involves the formation and fusion of gametes, and allows more rapid generation of genetic diversity by lateral gene transfer between cells. Sexually reproducing fungal cells assume two cell states throughout their life cycle, one being a diploid cell state and the other being a haploid cell state. Diploid fungal cells are generally very stable, and will generally remain in the diploid phase unless they encounter one or more of a number of particular environmental stimuli (e.g., nutrient deprivation). When one or more of such stimuli is encountered, the diploid cells sporulate to form four haploid spores (called tetrads). When favorable conditions return, these haploid spores germinate to produce four haploid cells (two of mating type a, and two of mating type alpha), which then can mate with other haploid cells of the opposite mating type to form a diploid cell again.

The ability of diploid fungal cells to sporulate and of haploid fungal cells to mate is dependent on the function of specific gene products. Among these in yeast cells are products of sporulation genes, such as of the IME1, IME2, NDT80, SPO11, SPO20, AMA1, HOP2, and SPO21 genes, and products of pheromone response genes, such as of the STE5, STE4, STE18, STE12, STE7 and STE11 genes.

In one aspect, provided herein is a genetically modified haploid fungal cell that is sporulation and/or endogenous mating impaired, and comprises a chromosomally integrated heterologous nucleotide sequence encoding a protein of interest. In some embodiments, the genetically modified fungal cell is a haploid yeast cell in which at least one sporulation gene and/or at least one pheromone response gene has been functionally disrupted.

In some embodiments, the genetically modified fungal cell is a haploid yeast cell in which one or more of the following sporulation genes is functionally disrupted: IME1, IME2, NDT80, SPO11, SPO20, AMA1, HOP2, and SPO21. In some embodiments, the genetically modified fungal cell is a haploid yeast cell in which the IME1 gene is functionally disrupted. In some embodiments, the genetically modified fungal cell is a haploid yeast cell in which the IME2 gene is functionally disrupted. In some embodiments, the genetically modified fungal cell is a haploid yeast cell in which the NDT80 gene is functionally disrupted. In some embodiments, the genetically modified fungal cell is a haploid yeast cell in which the SPO11 gene is functionally disrupted. In some embodiments, the genetically modified fungal cell is a haploid yeast cell in which the SPO20 gene is functionally disrupted. In some embodiments, the genetically modified fungal cell is a haploid yeast cell in which the AMA1 gene is functionally disrupted. In some embodiments, the genetically modified fungal cell is a haploid yeast cell in which the HOP2 gene is functionally disrupted. In some embodiments, the genetically modified fungal cell is a haploid yeast cell in which the SPO21 gene is functionally disrupted. In some embodiments, the genetically modified fungal cell is a haploid yeast cell in which more than one sporulation gene selected from the group consisting of IME1, IME2, NDT80, SPO11, SPO20, AMA1, HOP2, and SPO21 is disrupted. In some embodiments, the genetically modified fungal cell is a haploid yeast cell in which more than two sporulation genes selected from the group consisting of IME1, IME2, NDT80, SPO11, SPO20, AMA1, HOP2, and SPO21 are disrupted. In some embodiments, the genetically modified fungal cell is a haploid yeast cell in which more than three sporulation genes selected from the group consisting of IME1, IME2, NDT80, SPO11, SPO20, AMA1, HOP2, and SPO21 are disrupted. In some embodiments, the genetically modified fungal cell is a haploid yeast cell in which more than four sporulation genes selected from the group consisting of IME1, IME2, NDT80, SPO11, SPO20, AMA1, HOP2, and SPO21 are disrupted.

In some embodiments, the genetically modified fungal cell is a haploid yeast cell in which one or more of the following pheromone response genes is functionally disrupted: STE5, STE4, STEM, STE12, STE7, and STE11. In some embodiments, the genetically modified fungal cell is a haploid yeast cell in which the STE5 gene is functionally disrupted. In some embodiments, the genetically modified fungal cell is a haploid yeast cell in which the STE4 gene is functionally disrupted. In some embodiments, the genetically modified fungal cell is a haploid yeast cell in which the STEM gene is functionally disrupted. In some embodiments, the genetically modified fungal cell is a haploid yeast cell in which the STE12 gene is functionally disrupted. In some embodiments, the genetically modified fungal cell is a haploid yeast cell in which the STE7 gene is functionally disrupted. In some embodiments, the genetically modified fungal cell is a haploid yeast cell in which the STE11 gene is functionally disrupted. In some embodiments, the genetically modified fungal cell is a haploid yeast cell in which more than one pheromone response gene selected from the group consisting of STE5, STE4, STE18, STE12, STE7, and STE11 is disrupted. In some embodiments, the genetically modified fungal cell is a haploid yeast cell in which more than two pheromone response genes selected from the group consisting of STE5, STE4, STE18, STE12, STE7, and STE11 are disrupted. In some embodiments, the genetically modified fungal cell is a haploid yeast cell in which more than three pheromone response genes selected from the group consisting of STE5, STE4, STE18, STE12, STE7, and STE11 are disrupted. In some embodiments, the genetically modified fungal cell is a haploid yeast cell in which more than four pheromone response genes selected from the group consisting of STE5, STE4, STE18, STE12, STE7, and STE11 are disrupted.

In some embodiments, the genetically modified fungal cell is a haploid yeast cell in which at least one sporulation gene and at least one pheromone response gene have been functionally disrupted.

In some embodiments, the genetically modified fungal cell is a haploid yeast cell in which the IME1 gene and the STE5 gene are functionally disrupted. In some embodiments, the genetically modified fungal cell is a haploid yeast cell in which the IME2 gene and the STE5 gene are functionally disrupted. In some embodiments, the genetically modified fungal cell is a haploid yeast cell in which the NDT80 gene and the STE5 gene are functionally disrupted. In some embodiments, the genetically modified fungal cell is a haploid yeast cell in which the SPO11 gene and the STE5 gene are functionally disrupted. In some embodiments, the genetically modified fungal cell is a haploid yeast cell in which the SPO20 gene and the STE5 gene are functionally disrupted. In some embodiments, the genetically modified fungal cell is a haploid yeast cell in which the AMA1 gene and the STE5 gene are functionally disrupted. In some embodiments, the genetically modified fungal cell is a haploid yeast cell in which the HOP2 gene and the STE5 gene are functionally disrupted. In some embodiments, the genetically modified fungal cell is a haploid yeast cell in which the SPO21 gene and the STE5 gene are functionally disrupted.

In some embodiments, the genetically modified fungal cell is a haploid yeast cell in which the IME1 gene and the STE4 gene are functionally disrupted. In some embodiments, the genetically modified fungal cell is a haploid yeast cell in which the IME2 gene and the STE4 gene are functionally disrupted. In some embodiments, the genetically modified fungal cell is a haploid yeast cell in which the NDT80 gene and the STE4 gene are functionally disrupted. In some embodiments, the genetically modified fungal cell is a haploid yeast cell in which the SPO11 gene and the STE4 gene are functionally disrupted. In some embodiments, the genetically modified fungal cell is a haploid yeast cell in which the SPO20 gene and the STE4 gene are functionally disrupted. In some embodiments, the genetically modified fungal cell is a haploid yeast cell in which the AMA1 gene and the STE4 gene are functionally disrupted. In some embodiments, the genetically modified fungal cell is a haploid yeast cell in which the HOP2 gene and the STE4 gene are functionally disrupted. In some embodiments, the genetically modified fungal cell is a haploid yeast cell in which the SPO21 gene and the STE4 gene are functionally disrupted.

In some embodiments, the genetically modified fungal cell is a haploid yeast cell in which the IME1 gene and the STE18 gene are functionally disrupted. In some embodiments, the genetically modified fungal cell is a haploid yeast cell in which the IME2 gene and the STE18 gene are functionally disrupted. In some embodiments, the genetically modified fungal cell is a haploid yeast cell in which the NDT80 gene and the STE18 gene are functionally disrupted. In some embodiments, the genetically modified fungal cell is a haploid yeast cell in which the SPO11 gene and the STE18 gene are functionally disrupted. In some embodiments, the genetically modified fungal cell is a haploid yeast cell in which the SPO20 gene and the STE18 gene are functionally disrupted. In some embodiments, the genetically modified fungal cell is a haploid yeast cell in which the AMA1 gene and the STE18 gene are functionally disrupted. In some embodiments, the genetically modified fungal cell is a haploid yeast cell in which the HOP2 gene and the STE18 gene are functionally disrupted. In some embodiments, the genetically modified fungal cell is a haploid yeast cell in which the SPO21 gene and the STE18 gene are functionally disrupted.

In some embodiments, the genetically modified fungal cell is a haploid yeast cell in which the IME1 gene and the STE12 gene are functionally disrupted. In some embodiments, the genetically modified fungal cell is a haploid yeast cell in which the IME2 gene and the STE12 gene are functionally disrupted. In some embodiments, the genetically modified fungal cell is a haploid yeast cell in which the NDT80 gene and the STE12 gene are functionally disrupted. In some embodiments, the genetically modified fungal cell is a haploid yeast cell in which the SPO11 gene and the STE12 gene are functionally disrupted. In some embodiments, the genetically modified fungal cell is a haploid yeast cell in which the SPO20 gene and the STE12 gene are functionally disrupted. In some embodiments, the genetically modified fungal cell is a haploid yeast cell in which the AMA1 gene and the STE12 gene are functionally disrupted. In some embodiments, the genetically modified fungal cell is a haploid yeast cell in which the HOP2 gene and the STE12 gene are functionally disrupted. In some embodiments, the genetically modified fungal cell is a haploid yeast cell in which the SPO21 gene and the STE12 gene are functionally disrupted.

In some embodiments, the genetically modified fungal cell is a haploid yeast cell in which the IME1 gene and the STE7 gene are functionally disrupted. In some embodiments, the genetically modified fungal cell is a haploid yeast cell in which the IME2 gene and the STE7 gene are functionally disrupted. In some embodiments, the genetically modified fungal cell is a haploid yeast cell in which the NDT80 gene and the STE7 gene are functionally disrupted. In some embodiments, the genetically modified fungal cell is a haploid yeast cell in which the SPO11 gene and the STE7 gene are functionally disrupted. In some embodiments, the genetically modified fungal cell is a haploid yeast cell in which the SPO20 gene and the STE7 gene are functionally disrupted. In some embodiments, the genetically modified fungal cell is a haploid yeast cell in which the AMA1 gene and the STE7 gene are functionally disrupted. In some embodiments, the genetically modified fungal cell is a haploid yeast cell in which the HOP2 gene and the STE7 gene are functionally disrupted. In some embodiments, the genetically modified fungal cell is a haploid yeast cell in which the SPO21 gene and the STE7 gene are functionally disrupted.

In some embodiments, the genetically modified fungal cell is a haploid yeast cell in which the IME1 gene and the STE11 gene are functionally disrupted. In some embodiments, the genetically modified fungal cell is a haploid yeast cell in which the IME2 gene and the STE11 gene are functionally disrupted. In some embodiments, the genetically modified fungal cell is a haploid yeast cell in which the NDT80 gene and the STE11 gene are functionally disrupted. In some embodiments, the genetically modified fungal cell is a haploid yeast cell in which the SPO11 gene and the STE11 gene are functionally disrupted. In some embodiments, the genetically modified fungal cell is a haploid yeast cell in which the SPO20 gene and the STE11 gene are functionally disrupted. In some embodiments, the genetically modified fungal cell is a haploid yeast cell in which the AMA1 gene and the STE11 gene are functionally disrupted. In some embodiments, the genetically modified fungal cell is a haploid yeast cell in which the HOP2 gene and the STE11 gene are functionally disrupted. In some embodiments, the genetically modified fungal cell is a haploid yeast cell in which the SPO21 gene and the STE11 gene are functionally disrupted.

In some embodiments, the genetically modified fungal cell is a haploid yeast cell that comprises a functionally disrupted chromosomal copy of one or more pheromone response genes, and one or more recombinant plasmids comprising a functional extrachromosomal copy of a coding sequence of said one or more pheromone response genes. In some embodiments, the genetically modified fungal cell is a haploid yeast cell that comprises a functionally disrupted STE5 gene, and a recombinant plasmid comprising a functional extrachromosomal copy of a coding sequence of the STE5 gene. In some embodiments, the genetically modified fungal cell is a haploid yeast cell that comprises a functionally disrupted STE4 gene, and a recombinant plasmid comprising a functional extrachromosomal copy of a coding sequence of the STE4 gene. In some embodiments, the genetically modified fungal cell is a haploid yeast cell that comprises a functionally disrupted STEM gene, and a recombinant plasmid comprising a functional extrachromosomal copy of a coding sequence of the STEM gene. In some embodiments, the genetically modified fungal cell is a haploid yeast cell that comprises a functionally disrupted STE12 gene, and a recombinant plasmid comprising a functional extrachromosomal copy of a coding sequence of the STE12 gene. In some embodiments, the genetically modified fungal cell is a haploid yeast cell that comprises a functionally disrupted STE7 gene, and a recombinant plasmid comprising a functional extrachromosomal copy of a coding sequence of the STE7 gene. In some embodiments, the genetically modified fungal cell is a haploid yeast cell that comprises a functionally disrupted STE11 gene, and a recombinant plasmid comprising a functional extrachromosomal copy of a coding sequence of the STE11 gene.

In another aspect, provided herein is a genetically modified diploid fungal cell that is sporulation and/or endogenous mating impaired and comprises two copies of a chromosomally integrated heterologous nucleotide sequence encoding a protein of interest. In some embodiments, the genetically modified fungal cell is a diploid yeast cell in which both copies of at least one sporulation gene and/or both copies of at least one pheromone response gene have been functionally disrupted.

In some embodiments, the genetically modified fungal cell is a diploid yeast cell in which both copies of one or more of the following sporulation genes are functionally disrupted: IME1, IME2, NDT80, SPO11, SPO20, AMA1, HOP2, and SPO21. In some embodiments, the genetically modified fungal cell is a diploid yeast cell in which both copies of the IME1 gene are functionally disrupted. In some embodiments, the genetically modified fungal cell is a diploid yeast cell in which both copies of one or more of the following pheromone response genes are functionally disrupted: STE5, STE4, STEM, STE12, STET and STE11. In some embodiments, the genetically modified fungal cell is a diploid yeast cell in which both copies of the STE5 gene are functionally disrupted. In still other embodiments, the genetically modified fungal cell is a diploid yeast cell in which both copies of at least one sporulation gene and both copies of at least one pheromone response gene are functionally disrupted. In some embodiments, the genetically modified fungal cell is a diploid yeast cell in which the both copies of the IME1 gene and both copies of the STE5 gene are functionally disrupted.

In some embodiments, the genetically modified diploid fungal cell is homozygous other than for its mating type allele. For example, if the genetically modified diploid fungal cell should sporulate, the resulting four haploid fungal cells would be genetically identical except for their mating type allele. In such an event, two of the haploid cells would be mating type a and the other two haploid cells would be mating type alpha. In some embodiments, the genetically modified diploid fungal cell does not include a heterologous gene that confers resistance to an antibiotic compound.

The genetically modified diploid fungal cell provided herein possesses several safeguards against unwanted propogation of the heterologous nucleotide sequences contained therein. First, diploid fungal cells are generally very stable and, in their diploid state, cannot mate with other fungal cells. Second, the diploid fungal cell provided herein has an impaired ability to sporulate, and thus, even in the presence of the proper environmental stimuli, has little or no ability to form spores. Third, in the unlikely event that spores are formed, the resulting haploid fungal cells have an impaired ability to mate. Taken together, the sporulation and mating deficient nature of the genetically modified fungal cell provided herein significantly reduces the possibility of the migration of heterologous nucleotide sequences into wild type fungal cells.

In another aspect, provided herein is a method for generating a genetically modified diploid fungal cell described herein. In some embodiments, the method comprises: (a) obtaining a first genetically modified haploid fungal cell, wherein the first genetically modified haploid fungal cell is sporulation and endogenous mating impaired and comprises a chromosomally integrated heterologous nucleotide sequence encoding a protein of interest; (b) obtaining a second genetically modified haploid fungal cell, wherein the second genetically modified haploid fungal cell is sporulation and endogenous mating impaired, is of the opposite mating type as the first genetically modified haploid fungal cell, and comprises a chromosomally integrated heterologous nucleotide sequence encoding said protein of interest; (c) transforming each of the first and the second genetically modified haploid fungal cells with one or more plasmids encoding a protein capable of complementing the endogenous mating impairment of said first and second genetically modified haploid fungal cells; (d) mating the first genetically modified haploid fungal cell with the second genetically modified haploid fungal cell, thereby forming a genetically modified diploid fungal cell; and (e) eliminating the one or more plasmids from the genetically modified diploid fungal cell, wherein the resulting genetically modified diploid fungal cell is sporulation and endogenous mating impaired and comprises two copies of a chromosomally integrated heterologous nucleotide sequence encoding said protein of interest.

In some embodiments, the first genetically modified haploid fungal cell and the second genetically modified haploid fungal cell are endogenous mating impaired due to a functional disruption of one or more pheromone response genes. In some embodiments, step (c) of the method of the invention comprises transforming each of the first and the second genetically modified haploid fungal cells with one or more plasmids encoding a functional copy of the one or more pheromone response genes that are functionally disrupted in said first and second genetically modified haploid fungal cells. In some embodiments, the first and second genetically modified haploid fungal cells are haploid yeast cells and the one or more pheromone response genes is selected from the group consisting of STE5, STE4, STE18, STE12, STE7, and STE11. In certain embodiments, the first and second genetically modified haploid fungal cells are haploid yeast cells that are endogenous mating impaired due to a functional disruption of the STE5 gene.

In some embodiments, the first genetically modified haploid fungal cell and the second genetically modified haploid fungal cell are sporulation impaired due to a functional disruption of one or more sporulation genes. In some embodiments, the first and second genetically modified haploid fungal cells are haploid yeast cells, and the one or more sporulation genes is selected from the group consisting of IME1, IME2, NDT80, SPO11, SPO20, AMA1, HOP2, and SPO21. In some embodiments, the first and second genetically modified haploid fungal cells are haploid yeast cells that are sporulation impaired due to a functional disruption of the IME1 gene. In particular embodiments, the first and second genetically modified haploid fungal cells are haploid yeast cells that are endogenous mating impaired due to a functional disruption of the STE5 gene, and are sporulation impaired due to a functional disruption of the IME1 gene.

In some embodiments, the second genetically modified haploid fungal cell is obtained by inducing a mating type switch in a population of the first genetically modified haploid fungal cell. In some embodiments, the first genetically modified haploid fungal cell is a heterothallic (ho) haploid *Saccharomyces cerevisiae* cell, and said population of heterothallic (ho) haploid *Saccharomyces cerevisiae* cell is induced to switch mating type by transforming said heterothallic (ho) haploid *Saccharomyces cerevisiae* cell with a plasmid encoding a homothallism (HO) protein, wherein expression of the HO protein induces a mating type switch in the haploid *Saccharomyces cerevisiae* cell to yield the second genetically modified haploid *Saccharomyces cerevisiae* cell. Heterothallic (ho) haploid *Saccharomyces cerevisiae* cells are characterized by the virtual non-occurrence of spontaneous mating type switching (frequency of only $10^{-6}$). By transiently expressing the HO protein, the frequency of spontaneous mating type switching in a haploid *Saccharomyces cerevisiae* cell can be increased to as much as once every cell division, providing a population of haploid cells of opposite mating types that can mate with each other to yield diploid *Saccharomyces cerevisiae* cells.

In another aspect, provided herein is a method for generating a genetically modified heterothallic (ho) diploid yeast cell that lacks sporulation and endogenous mating capability, the method comprising: (a) obtaining a first genetically modified heterothallic haploid yeast cell, wherein the first genetically modified heterothallic haploid yeast cell comprises: (i) a chromosomally integrated heterologous nucleotide sequence encoding a protein of interest; and (ii) functional disruptions in one or more sporulation genes and one or more pheromone response genes; (b) transforming a population of the first genetically modified heterothallic haploid yeast cell with a plasmid encoding a homothallism (HO) protein to yield a first genetically modified haploid yeast cell, wherein expression of the HO protein induces a mating-type switch in the first genetically modified haploid yeast cell, whereby a second genetically modified haploid yeast cell is obtained, wherein the second genetically modified haploid yeast cell is of the opposite mating type as the first genetically modified haploid yeast cell and comprises: (i) a chromosomally integrated heterologous nucleotide sequence encoding said protein of interest; and (ii) functional disruptions in one or more sporulation genes and one or more pheromone response genes; (c) transforming each of the first and the second genetically modified haploid yeast cells with a plasmid encoding the one or more pheromone response proteins that are functionally disrupted in said first and second haploid yeast cell; (d) mating the first genetically modified haploid yeast cell with the second genetically modified haploid yeast cell, thereby forming a genetically modified diploid yeast cell that is homozygous other than for its mating type allele; and (e) eliminating any plasmids from the genetically modified diploid yeast cell to yield a genetically modified heterothallic diploid yeast cell, wherein the resulting genetically modified heterothallic diploid yeast cell is sporulation and endogenous mating impaired and comprises two copies of a chromosomally integrated heterologous nucleotide sequence encoding said protein of interest.

Although the steps of the methods provided herein and described in greater detail below are presented in sequential order, one of skill in the art will recognize that the order of several steps can be interchanged, combined, or repeated without exceeding the scope of the invention. Thus, in some embodiments, a genetically modified heterothallic (ho) diploid yeast cell that lacks sporulation and endogenous mating capability is generated by first transforming a genetically modified heterothallic haploid yeast cell with a plasmid encoding one or more pheromone response proteins that are functionally disrupted in said genetically modified heterothallic haploid yeast cell, and then transforming the cell with a plasmid encoding a homothallism (HO) protein. In other embodiments, the genetically modified heterothallic (ho) diploid yeast cell that lacks sporulation and endogenous mating capability is generated by simultaneously transforming a genetically modified heterothallic haploid yeast cell with a plasmid encoding one or more pheromone response proteins that are functionally disrupted in said genetically modified heterothallic haploid yeast cell, and a plasmid encoding a homothallism (HO) protein.

5.2.1 Microbe Selection

Microbes useful in the practice of the methods provided herein include eukaryotic unicellular organisms, particularly fungi, and more particularly yeasts.

In some embodiments, yeasts useful in the present methods include yeasts that have been deposited with microorganism depositories (e.g. IFO, ATCC, etc.) and belong to the genera *Aciculoconidium, Ambrosiozyma, Arthroascus, Arxiozyma, Ashbya, Babjevia, Bensingtonia, Botryoascus, Botryozyma, Brettanomyces, Bullera, Bulleromyces, Candida, Citeromyces, Clavispora, Cryptococcus, Cystofilobasidium, Debaryomyces, Dekkara, Dipodascopsis, Dipodascus, Eeniella, Endomycopsella, Eremascus, Eremothecium, Erythrobasidium, Fellomyces, Filobasidium, Galactomyces, Geotrichum, Guilliermondella, Hanseniaspora, Hansenula, Hasegawaea, Holtermannia, Hormoascus, Hyphopichia, Issatchenkia, Kloeckera, Kloeckeraspora, Kluyveromyces, Kondoa, Kuraishia, Kurtzmanomyces, Leucosporidium, Lipomyces, Lodderomyces, Malassezia, Metschnikowia, Mrakia, Myxozyma, Nadsonia, Nakazawaea, Nematospora, Ogataea, Oosporidium, Pachysolen, Phachytichospora, Phaffia, Pichia, Rhodosporidium, Rhodotorula, Saccharomyces, Saccharomycodes, Saccharomycopsis, Saitoella, Sakaguchia, Saturnospora, Schizoblastosporion, Schizosaccharomyces, Schwanniomyces, Sporidiobolus, Sporobolomyces, Sporopachydermia, Stephanoascus, Sterigmatomyces, Sterigmatosporidium, Symbiotaphrina, Sympodiomyces, Sympodiomycopsis, Torulaspora, Trichosporiella, Trichosporon, Trigonopsis, Tsuchiyaea, Udeniomyces, Waltomyces, Wickerhamia, Wickerhamiella, Williopsis, Yamadazyma, Yarrowia, Zygoascus, Zygosaccharomyces, Zygowilliopsis,* and *Zygozyma,* among others.

In some embodiments, the microbe is *Saccharomyces cerevisiae, Pichia pastoris, Schizosaccharomyces pombe, Dekkera bruxellensis, Kluyveromyces lactis* (previously called *Saccharomyces lactis*), *Kluveromyces marxianus, Arxula adeninivorans,* or *Hansenula polymorphs* (now known as *Pichia angusta*). In some embodiments, the microbe is a strain of the genus *Candida,* such as *Candida lipolytica, Candida guilliermondii, Candida krusei, Candida pseudotropicalis,* or *Candida utilis.*

In a particular embodiment, the microbe is *Saccharomyces cerevisiae.* In some embodiments, the microbe is a strain of *Saccharomyces cerevisiae* selected from the group consisting of Baker's yeast, CBS 7959, CBS 7960, CBS 7961, CBS 7962, CBS 7963, CBS 7964, IZ-1904, TA, BG-1, CR-1, SA-1, M-26, Y-904, PE-2, PE-5, VR-1, BR-1, BR-2, ME-2, VR-2, MA-3, MA-4, CAT-1, CB-1, NR-1, BT-1, and AL-1. In some embodiments, the microbe is a strain of *Saccharomyces cerevisiae* selected from the group consisting of PE-2, CAT-1, VR-1, BG-1, CR-1, and SA-1. In a particular embodiment, the strain of *Saccharomyces cerevisiae* is PE-2. In another particular embodiment, the strain of *Saccharomyces cerevisiae* is CAT-1. In another particular embodiment, the strain of *Saccharomyces cerevisiae* is BG-1.

In some embodiments, the microbe is a microbe that is suitable for industrial fermentation, e.g., bioethanol fermentation. In particular embodiments, the microbe is conditioned to subsist under high solvent concentration, high temperature, expanded substrate utilization, nutrient limitation, osmotic stress due to sugar and salts, acidity, sulfite and bacterial contamination, or combinations thereof, which are recognized stress conditions of the industrial fermentation environment.

5.2.2 Genetic Modification of Microbes

Methods for genetically modifying microbes using recombinant plasmid or chromosomal integration vectors are well known in the art. See, for example, Sherman, F., et al., *Methods Yeast Genetics,* Cold Spring Harbor Laboratory, N.Y. (1978); Guthrie, C., et al. (Eds.) *Guide To Yeast Genetics and Molecular Biology* Vol. 194, Academic Press, San Diego (1991); Sambrook et al., 2001, *Molecular Cloning—A Laboratory Manual,* 3$^{rd}$ edition, Cold Spring Harbor Laboratory, Cold Spring Harbor, N.Y.; and Ausubel et al., eds., Current Edition, *Current Protocols in Molecular Biology,* Greene Publishing Associates and Wiley Interscience, NY; the disclosures of which are incorporated herein by reference.

In some embodiments, the microbe is genetically modified to comprise one or more heterologous nucleotide sequences encoding enzymes of a new metabolic pathway, i.e., a metabolic pathway that produces a metabolite that is not endogenously produced by the microbe. In other embodiments, the microbe is genetically modified to comprise one or more heterologous nucleotide sequences encoding enzymes of a metabolic pathway that is endogenous to the microbe, i.e., a metabolic pathway that produces a metabolite that is endogenously produced by the microbe.

In some embodiments, the methods of the present invention require the use of recombinant plasmids to transiently express in the microbe a particular protein such as that encoded by one of the pheromone response genes or HO. Illustrative examples of recombinant plasmids suitable for use in yeast cells include CEN/ARS and 2µ plasmids.

In some embodiments, the microbes of the present invention do not comprise a heterologous nucleotide sequence encoding antibiotic resistance. Antibiotic resistance markers are commonly used in the construction of genetically modified cells. In such embodiments of the present invention in which the antibiotic resistance markers are used to mark genetic modifications introduced into the microbe, these markers are subsequently deleted after all of the desired genetic modifications are made to the microbe. Alternatively, other selection tools can be used in the construction of genetically modified microbes, such as auxotrophic complementation (e.g., HIS3, LEU2, LYS1, MET15, TRP1, ADE2, URA3, and LYS2).

5.2.3 Disruption of Sporulation and/or Pheromone Response Genes

The methods provided herein comprise a step of functionally disrupting one or more sporulation genes and/or one or more pheromone response genes in a genetically modified microbial cell. In some embodiments, disruption of the one or more sporulation genes results in a genetically modified microbial cell that lacks sporulation capability. In particular, genetically modified diploid microbial cells lack sporulation capability. In some embodiments, disruption of the one or more pheromone response genes results in a microbial cell that is endogenous mating impaired. In some embodiments, disruption of the one or more sporulation genes and of the one or more pheromone response genes results in a microbial cell that is sporulation and endogenous mating impaired.

In some embodiments, disruption of a sporulation or pheromone response gene is achieved by using a "disruption construct" that is capable of specifically disrupting a sporulation or pheromone response target gene upon introduction of the construct into the microbial cell, thereby rendering the disrupted gene non-functional. In some embodiments, disruption of the target gene prevents the expression of a functional protein. In some embodiments, disruption of the target gene results in expression of a non-functional protein from the disrupted gene. In some embodiments, disruption of a sporulation or pheromone response target gene is achieved by integration of a "disrupting sequence" within the target gene locus by homologous recombination. In such embodiments, the disruption construct comprises a disrupting sequence flanked by a pair of nucleotide sequences that are homologous to a pair of nucleotide sequences of the target gene locus (homologous sequences). Upon replacement of the targeted portion of the target gene by the disruption construct, the disrupting sequence prevents the expression of a functional protein, or causes expression of a non-functional protein, from the target gene.

Disruption constructs capable of disrupting one or more sporulation or pheromone response genes may be constructed using standard molecular biology techniques well known in the art. See, e.g., Sambrook et al., 2001, *Molecular Cloning—A Laboratory Manual*, 3$^{rd}$ edition, Cold Spring Harbor Laboratory, Cold Spring Harbor, N.Y., and Ausubel et al., eds., Current Edition, *Current Protocols in Molecular Biology*, Greene Publishing Associates and Wiley Interscience, NY. Parameters of disruption constructs that may be varied in the practice of the present methods include, but are not limited to, the lengths of the homologous sequences; the nucleotide sequence of the homologous sequences; the length of the disrupting sequence; the nucleotide sequence of the disrupting sequence; and the nucleotide sequence of the target gene. In some embodiments, an effective range for the length of each homologous sequence is 50 to 5,000 base pairs. In particular embodiments, the length of each homologous sequence is about 500 base pairs. For a discussion of the length of homology required for gene targeting, see Hasty et al., *Mol Cell Biol* 11:5586-91 (1991). In some embodiments, the homologous sequences comprise coding sequences of the target gene. In other embodiments, the homologous sequences comprise upstream or downstream sequences of the target gene. Is some embodiments, one homologous sequence comprises a nucleotide sequence that is homologous to a nucleotide sequence located 5' of the coding sequence of the target gene, and the other homologous sequence comprises a nucleotide sequence that is homologous to a nucleotide sequence located 3' of the coding sequence of the target gene. In some embodiments, the disrupting sequence comprises a nucleotide sequence encoding a selectable marker that enables selection of microbial cells comprising the disrupting sequence. Thus, in such embodiments, the disruption construct has a dual function, i.e., to functionally disrupt the target gene and to provide a selectable marker for the identification of cells in which the target gene is functionally disrupted. In some embodiments, a termination codon is positioned in-frame with and downstream of the nucleotide sequence encoding the selectable marker to prevent translational read-through that might yield a fusion protein having some degree of activity of the wild type protein encoded by the target gene. In some embodiments, the length of the disrupting sequence is one base pair. Insertion of a single base pair can suffice to disrupt a target gene because insertion of the single base pair in a coding sequence could constitute a frame shift mutation that could prevent expression of a functional protein. In some embodiments, the sequence of the disruption sequence differs from the nucleotide sequence of the target gene located between the homologous sequences by a single base pair. Upon replacement of the nucleotide sequence within the target gene with the disrupting sequence, the single base pair substitution that is introduced could result in a single amino acid substitution at a critical site in the protein and the expression of a non-functional protein. It should be recognized, however, that disruptions effected using very short disrupting sequences are susceptible to reversion to the wild type sequence through spontaneous mutation, thus leading to restoration of mating and sporulation capability to the host strain. Accordingly, in particular embodiments, the disrupting sequences are longer than one to a few base pairs. At the other extreme, a disrupting sequence of excessive length is unlikely to confer any advantage over a disrupting sequence of moderate length, and might diminish efficiency of transfection or targeting. Excessive length in this context is many times longer than the distance between the chosen homologous sequences in the target gene. Thus, in certain embodiments, the length for the disrupting sequence can be from 2 to 2,000 base pairs. In other embodiments, the length for the disrupting sequence is a length approximately equivalent to the distance between the regions of the target gene locus that match the homologous sequences in the disruption construct.

In some embodiments, the disruption construct is a linear DNA molecule. In other embodiments, the disruption construct is a circular DNA molecule. In some embodiments, the circular disruption construct comprises a pair of homologous sequences separated by a disrupting sequence, as described above. In some embodiments, the circular disruption construct comprises a single homologous sequence. Such circular disruption constructs, upon integration at the target gene locus, would become linearized, with a portion of the homologous sequence positioned at each end and the remaining segments of the disruption construct inserting into and disrupting the target gene without replacing any of the target gene nucleotide sequence. In particular embodiments, the single homologous sequence of a circular disruption construct is homologous to a sequence located within the coding sequence of the target gene.

Disruption constructs can be introduced into a microbial cell by any method known to one of skill in the art without limitation. Such methods include, but are not limited to, direct uptake of the molecule by a cell from solution, or facilitated uptake through lipofection using, e.g., liposomes or immunoliposomes; particle-mediated transfection; etc. See, e.g., U.S. Pat. No. 5,272,065; Goeddel et al., eds, 1990, Methods in Enzymology, vol. 185, Academic Press, Inc., CA; Krieger, 1990, Gene Transfer and Expression—A Laboratory Manual, Stockton Press, NY; Sambrook et al., 1989, Molecular Cloning—A Laboratory Manual, Cold Spring Harbor Laboratory, NY; and Ausubel et al., eds., Current Edition, Current Protocols in Molecular Biology, Greene Publishing Associates and Wiley Interscience, NY. Particular methods for transforming yeast cells are well known in the art. See Hinnen et al., Proc. Natl. Acad. Sci. USA 75:1292-3 (1978); Cregg et al., Mol. Cell. Biol. 5:3376-3385 (1985). Exemplary techniques include but are not limited to, spheroplasting, electroporation, PEG 1000 mediated transformation, and lithium acetate or lithium chloride mediated transformation.

5.2.3.1 Pheromone Response Genes

In some embodiments, the pheromone response gene disrupted in a yeast cell in accordance with the methods provided herein is STE5. The STE5 gene encodes a scaffold protein required for direct signaling through the yeast mating pathway to the mitogen-activated protein kinase (MAPK). See, e.g., Good et al., Cell March 20; 136(6):1085-97 (2009). Representative STE5 nucleotide sequences of Saccharomyces cerevisiae include Genbank accession number L23856, and SEQ ID NOS: 17, 45, 73, 101, and 129 as provided herein. Representative Ste5 protein sequences of Saccharomyces cerevisiae include Genbank accession number AAA35115, and SEQ ID NOS: 18, 46, 74, 102, and 130 as provided herein.

In some embodiments, the pheromone response gene disrupted in a yeast cell in accordance with the methods provided herein is STE4. The STE4 gene encodes a G protein beta subunit that forms a dimer with Ste18p to activate the mating signaling pathway. The sequence of the STE4 gene of Saccharomyces cerevisiae has been previously described. Dujon et al., Nature 387 (6632 Suppl):98-102 (1997). Representative STE4 nucleotide sequences of Saccharomyces cerevisiae include Genbank accession number NC_001147.5, and SEQ ID NOS: 19, 47, 75, 103, and 131 as provided herein. Representative Step 4 protein sequences of Saccharomyces cerevisiae include Genbank accession number NP 014855, and SEQ ID NOS: 20, 48, 76, 104, and 132 as provided herein.

In some embodiments, the pheromone response gene disrupted in a yeast cell in accordance with the methods provided herein is STE18. The STE18 gene encodes a G protein gamma subunit that forms a dimer with Ste4p to activate the mating signaling pathway. The sequence of the STE18 gene of Saccharomyces cerevisiae has been previously described. See, e.g., Goffeau et al., Science 274 (5287):546-547 (1996). Representative STEM nucleotide sequences of Saccharomyces cerevisiae include Genbank accession number NC_001147.5, and SEQ ID NOS: 21, 49, 77, 105, and 133 as provided herein. Representative Ste18 protein sequences of Saccharomyces cerevisiae include Genbank accession number NP_012619, and SEQ ID NOS: 22, 50, 78, 106, and 134 as provided herein.

In some embodiments, the pheromone response gene disrupted in a yeast cell in accordance with the methods provided herein is STE12. The STE12 gene encodes a transcription factor that is activated by a MAP kinase signaling cascade, and that activates genes involved in mating or pseudohyphal/invasive growth pathways. The sequence of the STE12 gene of Saccharomyces cerevisiae has been previously described. See, e.g., Goffeau et al., Science 274 (5287):546-547 (1996). Representative STE12 nucleotide sequences of Saccharomyces cerevisiae include Genbank accession number NC 001140.5, and SEQ ID NOS: 23, 51, 79, 107, and 135 as provided herein. Representative Ste12 protein sequences of Saccharomyces cerevisiae include Genbank accession number NP_011952, and SEQ ID NOS: 24, 52, 80, 108 and 136 as provided herein.

In some embodiments, the pheromone response gene disrupted in a yeast cell in accordance with the methods provided herein is STE7. The STE7 gene encodes a signal transducing MAP kinase kinase involved in pheromone response where it phosphorylates Fus3p. The sequence of the STE7 gene of Saccharomyces cerevisiae has been previously described. See, e.g., Teague et al., Proc Natl Acad Sci USA. 83(19): 7371-5 (1986). Representative STET nucleotide sequences of Saccharomyces cerevisiae include Genbank accession number Z74207, and SEQ ID NOS: 25, 53, 81, 109, and 137 as provided herein. Representative Step 7 protein sequences of Saccharomyces cerevisiae include Genbank accession number CAA98732, and SEQ ID NOS: 26, 54, 82, 110, and 138 as provided herein.

In some embodiments, the pheromone response gene disrupted in a yeast cell in accordance with the methods provided herein is STE11. The STE11 gene encodes a signal transducing MEK kinase involved in pheromone response and pseudohyphal/invasive growth pathways where it phosphorylates Ste7p. The sequence of the STE11 gene of Saccharomyces cerevisiae has been previously described. See, e.g., Johnston et al., Nature 387 (6632 Suppl), 87-90 (1997). Representative STE11 nucleotide sequences of Saccharomyces cerevisiae include Genbank accession number NC 001144.4, and SEQ ID NOS: 27, 55, 83, 111, and 139 as provided herein. Representative Ste11 protein sequences of Saccharomyces cerevisiae include Genbank accession number NP 013466, and SEQ ID NOS: 28, 56, 84, 112, and 140 as provided herein.

5.2.3.2 Sporulation Genes

In some embodiments, the sporulation gene disrupted in a yeast cell in accordance with the methods provided herein is IME1. The IME1 gene encodes a transcription factor that activates early meiotic gene transcription, which is required for initiation of meiosis. The sequence of the IME1 gene of Saccharomyces cerevisiae has been previously described. See, e.g., Smith, H. E., et al., Mol. Cell. Biol. 10 (12):6103-6113 (1990). Representative IME1 nucleotide sequences of Saccharomyces cerevisiae include Genbank accession number M37188, and SEQ ID NOS: 1, 29, 57, 85, and 113 as provided herein. Representative Ime1 protein sequences of Saccharomyces cerevisiae include Genbank accession number AAA86790, and SEQ ID NOS: 2, 30, 58, 86, and 114 as provided herein.

In some embodiments, the sporulation gene disrupted in a yeast cell in accordance with the methods provided herein is IME2. The IME2 gene encodes a serine/threonine protein kinase involved in activation of meiosis. The sequence of the IME2 gene of Saccharomyces cerevisiae has been previously described. See, e.g., EMBO J. 15 (9), 2031-2049 (1996). Representative IME2 nucleotide sequences of Saccharomyces cerevisiae include Genbank accession number NC_001142, and SEQ ID NOS: 3, 31, 59, 87, and 115 as provided herein. Representative Ime2 protein sequences of Saccharomyces cerevisiae include Genbank accession number NP_012429, and SEQ ID NOS: 4, 32, 60, 88, and 116 as provided herein.

In some embodiments, the sporulation gene disrupted in a yeast cell in accordance with the methods provided herein is NDT80. The NDT80 gene encodes a meiosis-specific transcription factor required for exit from pachytene and for full meiotic recombination. The Ndt80 protein also activates middle sporulation genes. The sequence of the NDT80 gene of Saccharomyces cerevisiae has been previously described. See, e.g., Goffeau et al., Science 274 (5287):546-547 (1996). Representative NDT80 nucleotide sequences of Saccharomyces cerevisiae include Genbank accession number NC_001140, and SEQ ID NOS: 5, 33, 61, 89, and 117 as provided herein. Representative Ndt80 protein sequences of Saccharomyces cerevisiae include Genbank accession number NP_011992, and SEQ ID NOS: 6, 34, 62, 90, and 118 as provided herein.

In some embodiments, the sporulation gene disrupted in a yeast cell in accordance with the methods provided herein is SPO11. The SPO11 gene is required for meiotic recombination. The sequence of the SPO11 gene of Saccharomyces cerevisiae has been previously described. See, e.g., Atcheson et al., *Proc. Natl. Acad. Sci. U.S.A.* 84 (22), 8035-8039 (1987). Representative SPO11 nucleotide sequences of *Saccharomyces cerevisiae* include Genbank accession number J02987, and SEQ ID NOS: 7, 35, 63, 91, and 119 as provided herein. Representative Spo11 protein sequences of *Saccharomyces cerevisiae* include Genbank accession number AAA65532, and SEQ ID NOS: 8, 36, 64, 92, and 120 as provided herein.

In some embodiments, the sporulation gene disrupted in a yeast cell in accordance with the methods provided herein is SPO20. The SPO20 gene encodes a meiosis-specific subunit of the t-SNARE complex, required for prospore membrane formation during sporulation. The sequence of the SPO20 gene of *Saccharomyces cerevisiae* has been previously described. See, e.g., Bowman et al., *Nature* 387 (6632 Suppl), 90-93 (1997). Representative SPO20 nucleotide sequences of *Saccharomyces cerevisiae* include Genbank accession number AF078740, and SEQ ID NOS: 9, 37, 65, 93, and 121 as provided herein. Representative Spo20 protein sequences of *Saccharomyces cerevisiae* include Genbank accession number NP 013730, and SEQ ID NOS: 10, 38, 66, 94, and 122 as provided herein.

In some embodiments, the sporulation gene disrupted in a yeast cell in accordance with the methods provided herein is AMA1. The AMA1 gene encodes an activator of the meiotic anaphase promoting complex. The sequence of the AMA1 gene of *Saccharomyces cerevisiae* has been previously described. See, e.g., Tettelin et al., *Nature* 387 (6632 Suppl): 81-84 (1997). Representative AMA1 nucleotide sequences of *Saccharomyces cerevisiae* include Genbank accession number NC 001139.8, and SEQ ID NOS: 11, 39, 67, 95, and 123 as provided herein. Representative Ama1 protein sequences of *Saccharomyces cerevisiae* include Genbank accession number NP 011741, and SEQ ID NOS: 12, 40, 68, 96, and 124 as provided herein.

In some embodiments, the sporulation gene disrupted in a yeast cell in accordance with the methods provided herein is HOP2. The HOP2 gene encodes a meiosis-specific protein which the ensures synapsis between homologous chromosomes. The sequence of the HOP2 gene of *Saccharomyces cerevisiae* has been previously described. See, e.g., Leu et al., *Cell* 94 (3):375-386 (1998). Representative HOP2 nucleotide sequences of *Saccharomyces cerevisiae* include Genbank accession number AF_078740.1, and SEQ ID NOS: 13, 41, 69, 97, and 125 as provided herein. Representative Hop2 protein sequences of *Saccharomyces cerevisiae* include Genbank accession number AAC31823, and SEQ ID NOS: 14, 42, 70, 98, and 126 as provided herein.

In some embodiments, the sporulation gene disrupted in a yeast cell in accordance with the methods provided herein is SPO21. The SPO21 gene encodes a component of the meiotic outer plaque of the spindle pole body, involved in modifying the meiotic outer plaque that is required prior to prospore membrane formation. The sequence of the SPO21 gene of *Saccharomyces cerevisiae* has been previously described. See, e.g., Dujon et al., *Nature* 387 (6632 Suppl):98-102 (1997). Representative SPO21 nucleotide sequences of *Saccharomyces cerevisiae* include Genbank accession number NC_001147.5, and SEQ ID NOS: 15, 43, 71, 99, and 127 as provided herein. Representative Spo21 protein sequences of *Saccharomyces cerevisiae* include Genbank accession number NP_014550, and SEQ ID NOS: 16, 44, 72, 100, and 128 as provided herein.

5.2.4 Preparation of Diploids

The methods provided herein comprise a step of inducing mating among haploid cells that comprise a functional disruption in one or more sporulation genes and/or a functional disruption in one or more pheromone response genes. The diploid cells formed as a result of said mating are stable diploid cells constrained to the diploid phase due to the functional disruption of the one or more sporulation genes of the cell.

To form a diploid cell from haploid cells that lack mating capability, the mating-impaired haploid cells are transformed with a "mating complement plasmid," i.e., a recombinant plasmid comprising a heterologous gene that can complement the mating deficiency caused by the functional disruption in the one or more pheromone response genes. Transient expression of the heterologous pheromone response gene within the haploid cells temporarily restores mating function to the cells and enables haploid cells of opposite mating type to form a stable diploid cell. In particular, the stable diploid cells formed thereby are homozygous other than for their mating type allele, being generated from haploids of the same genetically modified population.

Thus, in some embodiments in which the haploid cell comprises a functional disruption of the STE5 gene, the haploid cell is transformed with a mating complement plasmid comprising a STE5 coding sequence. In some embodiments in which the haploid cell comprises a functional disruption of the STE4 gene, the haploid cell is transformed with a mating complement plasmid comprising a STE4 coding sequence. In some embodiments in which the haploid cell comprises a functional disruption of the STE18 gene, the haploid cell is transformed with a mating complement plasmid comprising a STE18 coding sequence. In embodiments in which the haploid cell comprises a functional disruption of the STE12 gene, the haploid cell is transformed with a mating complement plasmid comprising a STE12 coding sequence. In embodiments in which the a haploid cell comprises a functional disruption of the STE7 gene, the haploid cell is transformed with a mating complement plasmid encoding a STE7 coding sequence. In some embodiments in which the haploid cell comprises a functional disruption of the STE11 gene, the haploid cell is transformed with a mating complement plasmid comprising a STE11 coding sequence.

Techniques for the construction of expression vectors and expression of genes in cells comprising the expression vectors are well known in the art. See, e.g., Sambrook et al., 2001, *Molecular Cloning—A Laboratory Manual*, 3rd edition, Cold Spring Harbor Laboratory, Cold Spring Harbor, N.Y., and Ausubel et al., eds., Current Edition, *Current Protocols in Molecular Biology*, Greene Publishing Associates and Wiley Interscience, NY. Plasmids encoding mating complement genes can be introduced into the host cell by any method known to one of skill in the art.

Plasmid-based systems generally require selective pressure on the plasmids to maintain the foreign DNA in the cell. Most plasmids in yeast are relatively unstable, as a yeast cell typically loses 10% of plasmids contained in the cell after each mitotic division. Thus, in some embodiments, selection of diploid cells that were formed by the mating of haploid cells comprising a plasmid encoding a mating complement gene but that do not themselves comprise the plasmid is achieved by allowing the diploid cells to undergo sufficient mitotic divisions such that the plasmid is effectively diluted from the population. Alternatively, diploid cells can be selected by selecting for the absence of the plasmid, e.g., by selecting against a counter-selectable marker (such as, for example, URA3) or by plating identical colonies on both selective media and non-selective media and then selecting a colony that does not grow on the selective media but does grow on the non-selective media.

In some embodiments, the methods provided herein comprise a step of transforming a haploid heterothallic (ho) yeast cell with a recombinant plasmid encoding a homothallism (HO) protein, wherein expression of the HO protein induces a mating-type switch of the haploid cell. The sequence of the HO gene of *Saccharomyces cerevisiae* has been previously described. See, e.g., Russell et al., *Mol. Cell. Biol.* 6 (12): 4281-4294 (1986). Representative HO nucleotide sequences of *Saccharomyces cerevisiae* include Genbank accession number NC_001136, and SEQ ID NO: 151 as provided herein. Representative HO protein sequences of *Saccharomyces cerevisiae* include Genbank accession number NP_010054, and SEQ ID NO: 152 as provided herein.

EXAMPLES

Example 1

Generation of Genetically Modified Haploid Cells

This example describes an exemplary method for generating genetically modified haploid *S. cerevisiae* cells.

The Phase I disruption construct (FIG. 1; SEQ ID NO: 141) comprises as a disrupting sequence nucleotide sequences that encode a selectable marker (hygA, which confers resistance to hygromycin B); two enzymes of the *S. cerevisiae* MEV pathway (the truncated HMG1 coding sequence, which encodes a truncated HMG-CoA reductase, and the ERG13 coding sequence, which encodes HMG-CoA synthase), and another enzyme of *S. cerevisiae* (the ERG10 coding sequence, which encodes acetoacetyl-CoA thiolase), under control of galactose-inducible promoters (promoters of the *S. cerevisiae* genes GAL1 and GAL10); flanked by homologous sequences consisting of upstream and downstream nucleotide sequences of the *S. cerevisiae* GAL80 locus. Upon introduction into a *S. cerevisiae* host cell, the Phase I disruption construct can integrate by homologous recombination into the GAL80 locus of the *S. cerevisiae* host cell genome, and functionally disrupt the GAL80 locus by replacing the GAL80 coding sequence with its disrupting sequence. The Phase I disruption construct was cloned into the TOPO Zero Blunt II cloning vector (Invitrogen, Carlsbad, Calif.), yielding plasmid TOPO-Phase I disruption construct. The construct was propagated in TOP10 cells grown on LB agar containing 50 μg/ml kanamycin.

Figure 2:
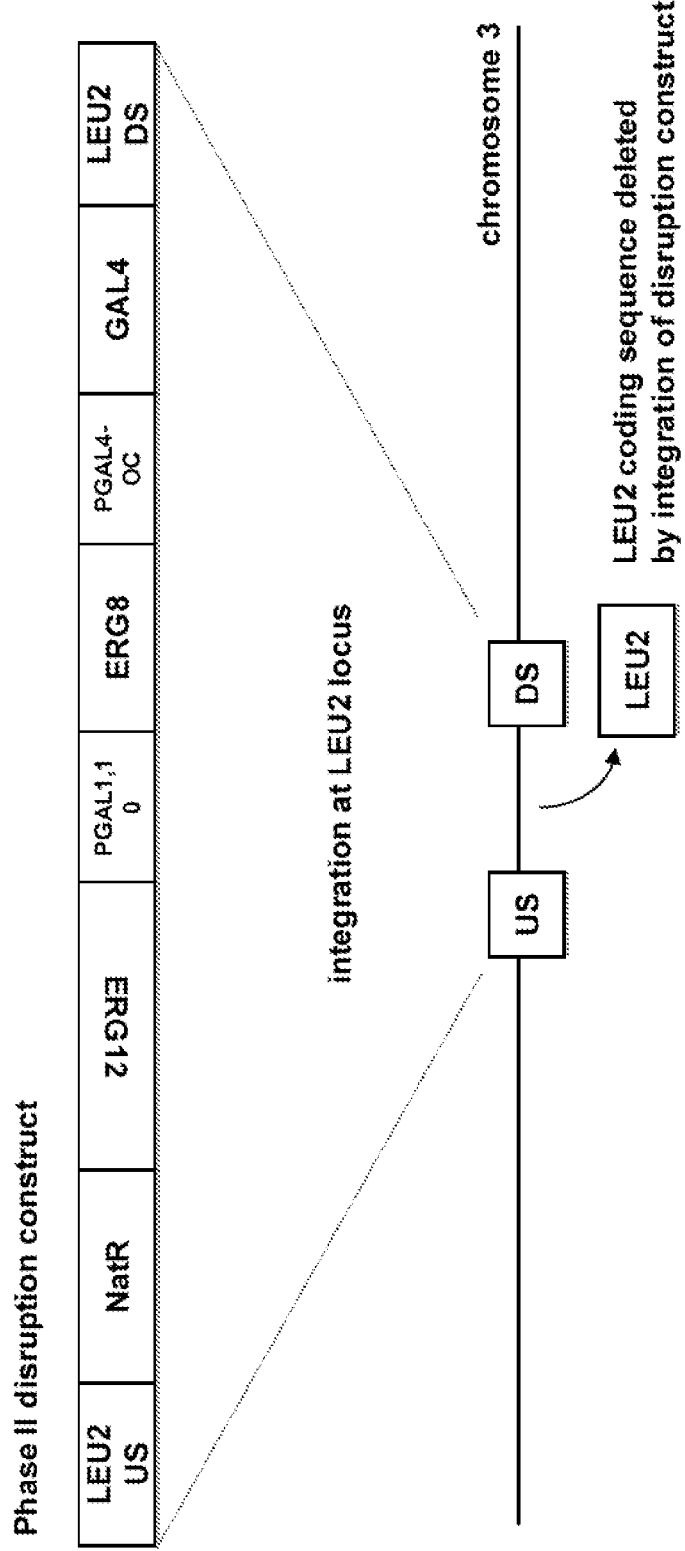
FIG. 2 provides the structure of the Phase II disruption construct and of the target locus after integration of the disrupting sequence by homologous recombination.

The Phase II disruption construct (FIG. 2; SEQ ID NO: 142) comprises as a disrupting sequence nucleotide sequences encoding a selectable marker (natA, which confers resistance to nourseothricin) and several enzymes of the *S. cerevisiae* MEV pathway (the ERG12 coding sequence, which encodes mevalonate kinase, and the ERG8 coding sequence, which encodes phosphomevalonate kinase), under the control of galactose-inducible promoters (promoters of the *S. cerevisiae* genes GAL1 and GAL10); as well as the coding sequence of the *S. cerevisiae* GAL4 gene under the control of the GAL4oc promoter (GAL4 promoter comprising a mutation that removes the MIG1 binding site, thus making the promoter less sensitive to the repression by glucose); flanked by homologous sequences consisting of upstream and downstream nucleotide sequences of the *S. cerevisiae* LEU2 locus. Upon introduction into a *S. cerevisiae* host cell, the Phase II disruption construct can integrate by homologous recombination into the LEU2 locus of the *S. cerevisiae* host cell genome, and functionally disrupt the LEU2 locus by replacing the LEU2 coding sequence with its disrupting sequence. The Phase II disruption construct was cloned into the TOPO Zero Blunt II cloning vector, yielding plasmid TOPO-Phase II disruption construct. The construct was propagated in TOP10 cells (Invitrogen, Carlsbad, Calif.) grown on LB agar containing 50 μg/ml kanamycin.

Figure 3:
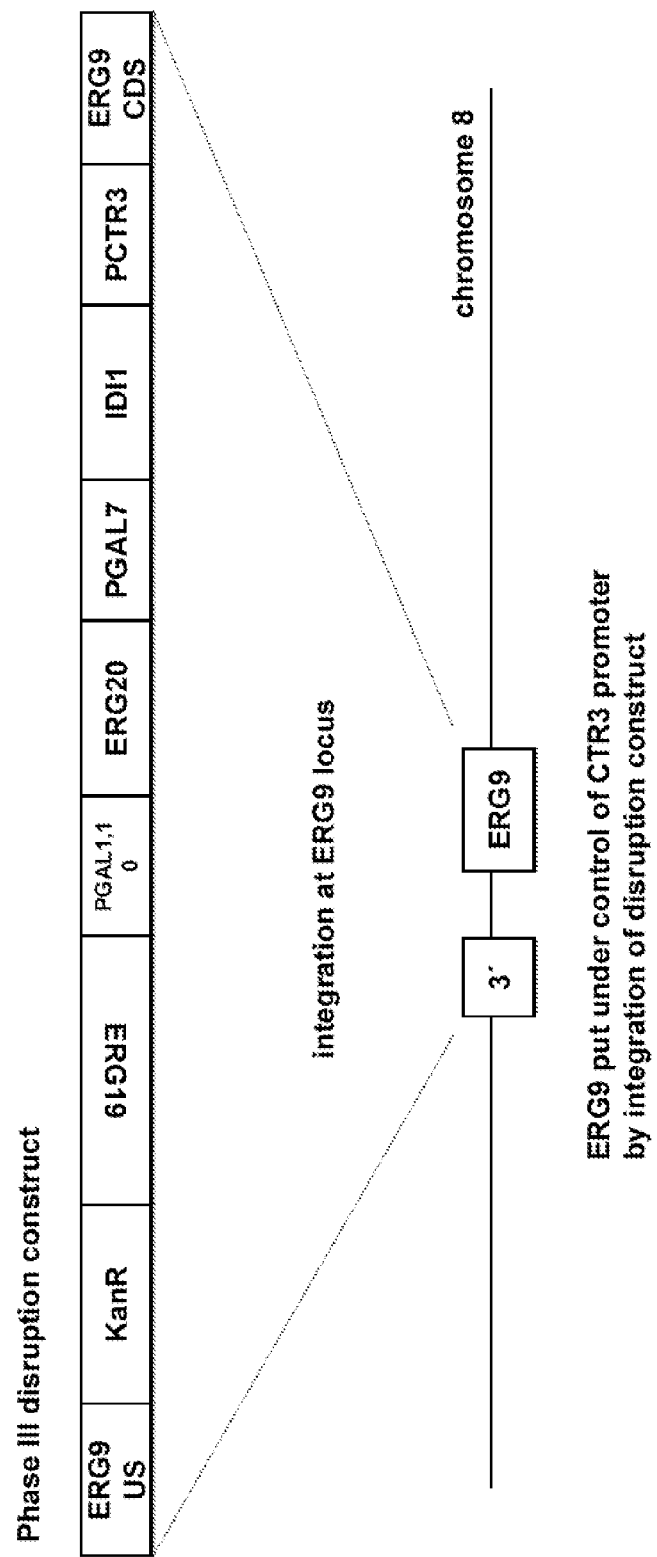
FIG. 3 provides the structure of the Phase III disruption construct and of the target locus after integration of the disrupting sequence by homologous recombination.

The Phase III disruption construct (FIG. 3; SEQ ID NO: 143) comprises as a disrupting sequence nucleotide sequences encoding a selectable marker (kanA, which confers resistance to G418); an enzyme of the *S. cerevisiae* MEV pathway (the ERG19 coding sequence, which encodes diphosphomevalonate decarboxylase), and two enzymes of *S. cerevisiae* involved in converting the product of the MEV pathway, IPP, into FPP (the ERG20 coding sequence encodes farnesyl pyrophosphate synthase, and the IDI1 coding sequence encodes isopentenyl pyrophosphate decarboxylase), under control of galactose-inducible promoters (promoters of the *S. cerevisiae* genes GAL1, GAL10, and GAL7); as well as the promoter of the *S. cerevisiae* CTR3 gene; flanked by upstream and coding nucleotide sequences of the *S. cerevisiae* ERG9 locus. Upon introduction into a *S. cerevisiae* host cell, the Phase II disruption construct can integrate by homologous recombination upstream of the ERG9 locus of the *S. cerevisiae* host cell genome, replacing the native ERG9 promoter with the CTR3 promoter in such a way that the expression of ERG9 (squalene synthase) can be modulated by copper. The Phase III disruption construct was cloned into the TOPO Zero Blunt II cloning vector, yielding plasmid TOPO-Phase III disruption construct. The construct was propagated in TOP10 cells grown on LB agar containing 50 μg/ml kanamycin.

Figure 4:
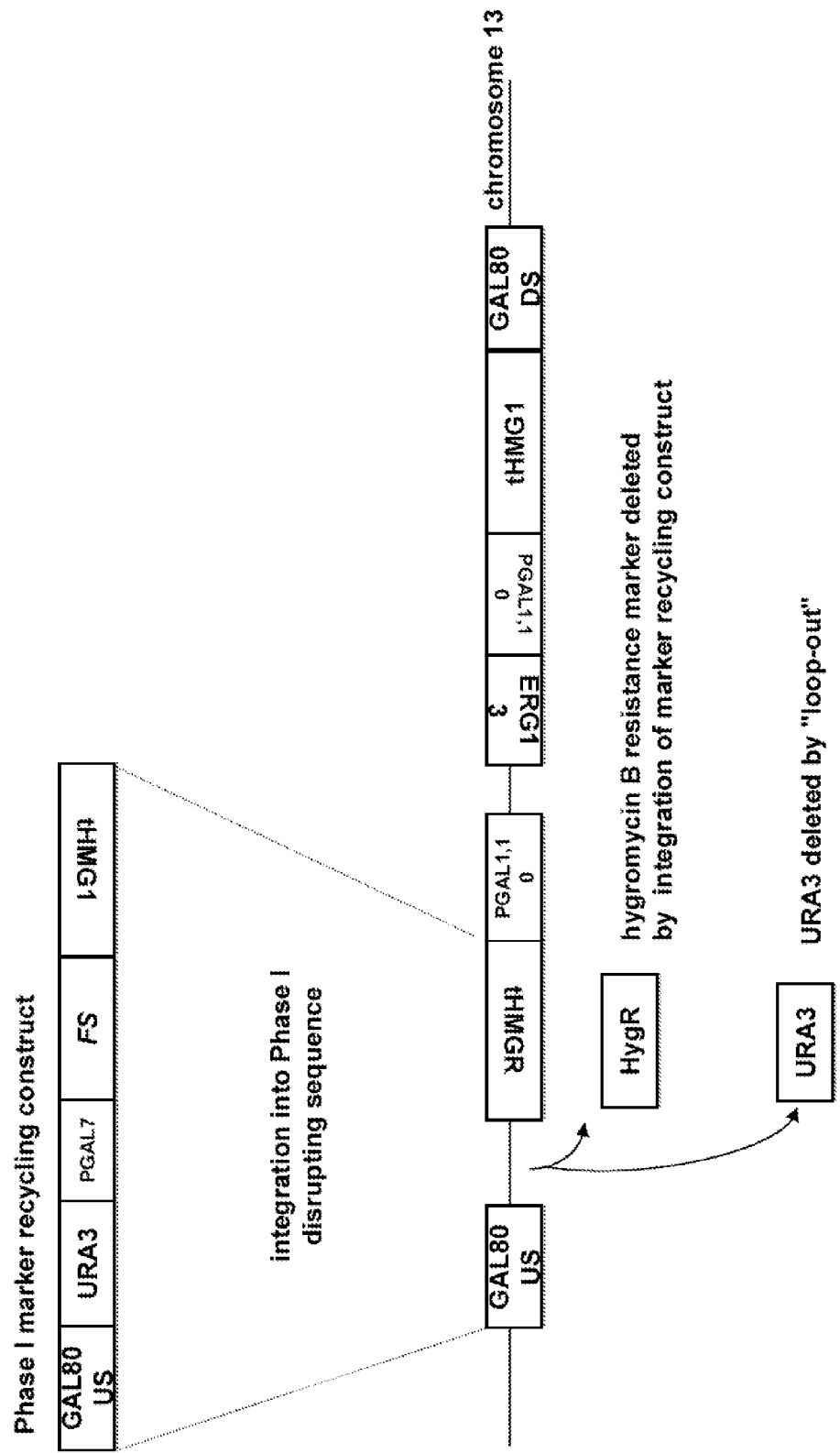
FIG. 4 provides the structure of the Phase I marker recycling construct and of the target locus after integration of the construct by homologous recombination.

The Phase I marker recycling construct (FIG. 4; SEQ ID NO: 144) comprises nucleotide sequences encoding a selectable marker (URA3, which confers the ability to grow on media lacking uracil); and an enzyme of *A. annua* (the FS coding sequence, which encodes farnesene synthase), under regulatory control of the promoter of the *S. cerevisiae* GAL7 gene; flanked by upstream nucleotide sequences of the *S. cerevisiae* GAL80 locus and coding sequences of the *S. cerevisiae* HMG1 gene. Upon introduction into a *S. cerevisiae* host cell, the Phase I marker recycling construct can integrate by homologous recombination into the already integrated Phase I disrupting sequence such that the selective marker hphA is replaced with URA3.

Figure 5:
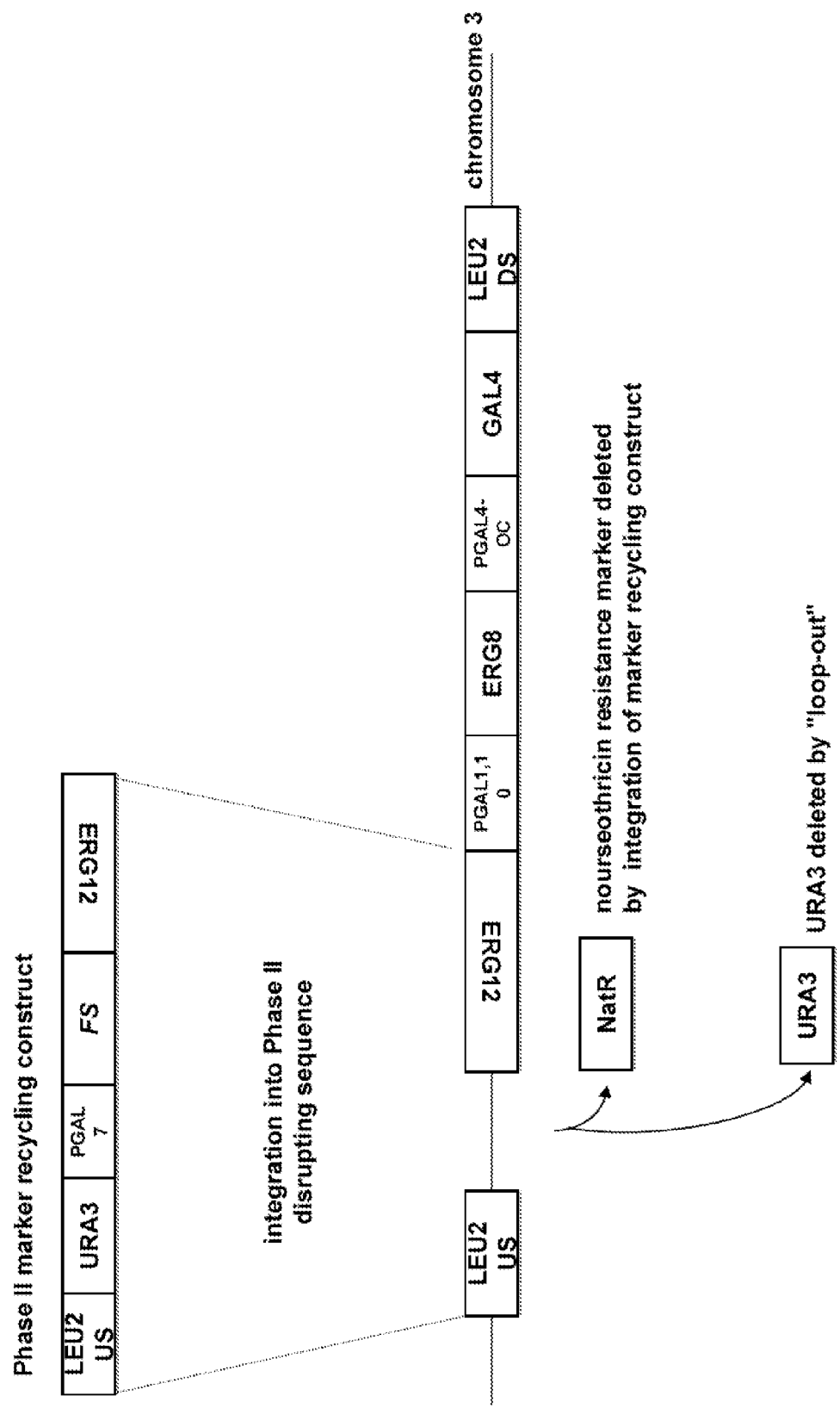
FIG. 5 provides the structure of the Phase II marker recycling construct and of the target locus after integration of the construct by homologous recombination.

The Phase II marker recycling construct (FIG. 5; SEQ ID NO: 145) comprises nucleotide sequences encoding a selectable marker (URA3, which confers the ability to grow on media lacking uracil) and an enzyme of *A. annua* (the FS coding sequence, which encodes farnesene synthase), under regulatory control of the promoter of the *S. cerevisiae* GAL7 gene; flanked by upstream nucleotide sequences of the *S. cerevisiae* LEU2 locus and coding sequences of the *S. cerevisiae* ERG12 gene. Upon introduction into a *S. cerevisiae* host cell, the Phase II marker recycling construct can integrate by homologous recombination into the already integrated Phase II disrupting sequence such that the selective marker natA is replaced with URA3.

Figure 6:
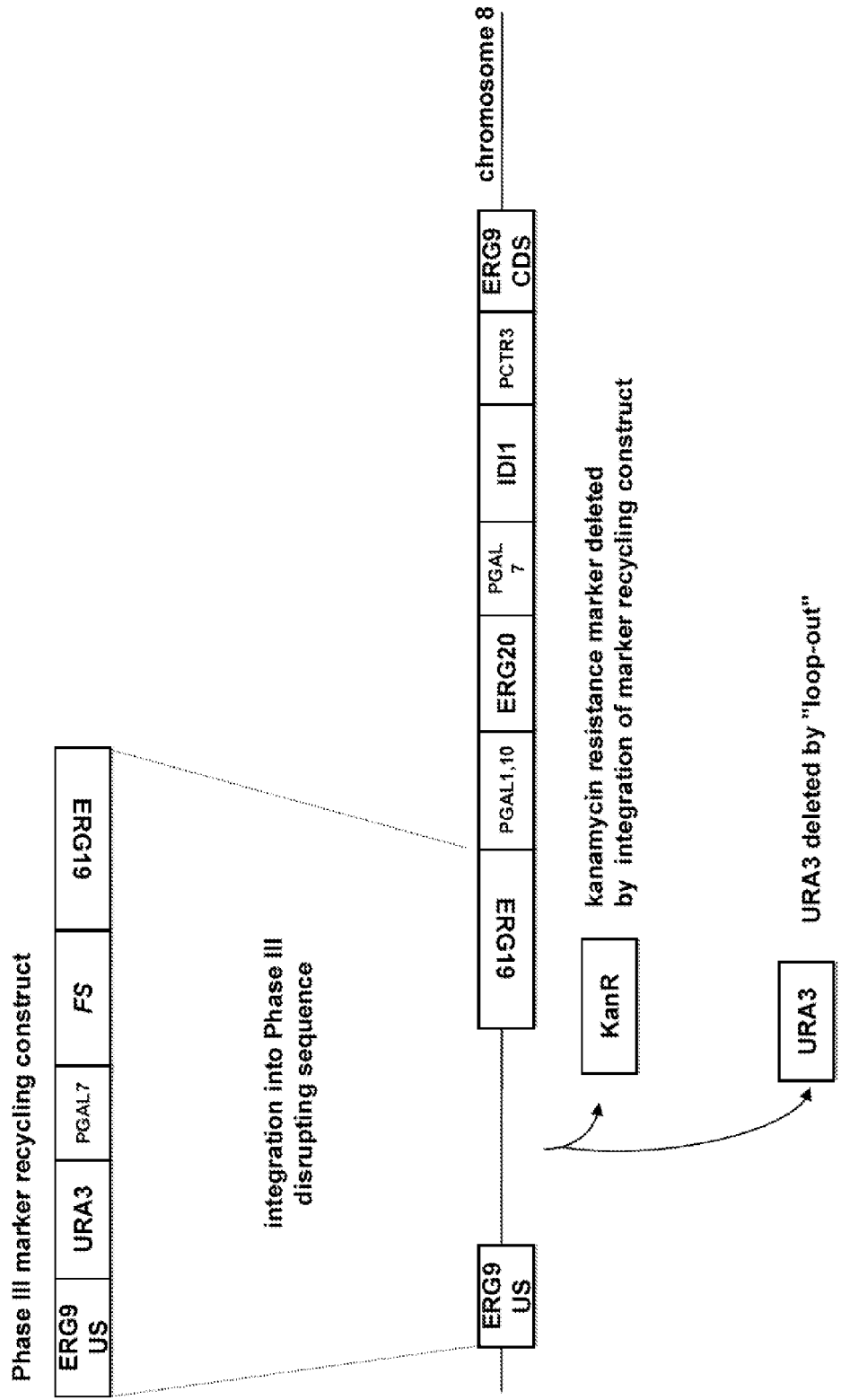
FIG. 6 provides the structure of the Phase III marker recycling construct and of the target locus after integration of the construct by homologous recombination.

The Phase III marker recycling construct (FIG. 6; SEQ ID NO: 146) comprises nucleotide sequences encoding a selectable marker (URA3, which confers the ability to grow on media lacking uracil) and an enzyme of *A annua* (the FS coding sequence, which encodes farnesene synthase), under regulatory control of the promoter of the *S. cerevisiae* GAL7 gene; flanked by upstream nucleotide sequences of the *S. cerevisiae* ERG9 locus and coding sequences of the *S. cerevisiae* ERG19 gene. Upon introduction into a *S. cerevisiae* host cell, the Phase II marker recycling construct can integrate by homologous recombination into the already integrated Phase III disrupting sequence such that the selective marker kanA is replaced with URA3.

Expression plasmid pAM404 (SEQ ID NO: 153) encodes a β-farnesene synthase. The nucleotide sequence insert was generated synthetically, using as a template the coding sequence of the β-farnesene synthase gene of *Artemisia annua* (GenBank accession number AY835398) codon-optimized for expression in *Saccharomyces cerevisiae*.

Starter host strain Y1198 was generated by resuspending active dry PE-2 yeast (isolated in 1994; gift from Santelisa Vale, Sertãozinho, Brazil) in 5 mL of YPD medium containing 100 ug/mL carbamicillin and 50 ug/mL kanamycin. The culture was incubated overnight at 30° C. on a rotary shaker at 200 rpm. An aliquot of 10 uL of the culture was then plated on a YPD plate and allowed to dry. The cells were serially streaked for single colonies, and incubated for 2 days at 30° C. Twelve single colonies were picked, patched out on a new YPD plate, and allowed to grow overnight at 30° C. The strain identities of the colonies were verified by analyzing their chromosomal sizes on a Bio-Rad CHEF DR II system (Bio-Rad, Hercules, Calif.) using the Bio-Rad CHEF Genomic DNA Plug Kit (Bio-Rad, Hercules, Calif.) according to the manufacturer's specifications. One colony was picked and stocked as strain Y1198.

Strains Y1661, Y1662, Y1663, and Y1664 were generated from strain Y1198 by rendering the strain haploid to permit genetic engineering. Strain Y1198 was grown overnight in 5 mL of YPD medium at 30° C. in a glass tube in a roller drum. The OD600 was measured, and the cells were diluted to an OD600 of 0.2 in 5 mL of YP medium containing 2% potassium acetate. The culture was grown overnight at 30° C. in a glass tube in a roller drum. The OD600 was measured again, and 4 OD600*mL of cells was collected by centrifugation at 5,000×g for 2 minutes. The cell pellet was washed once with sterile water, and then resuspended in 3 mL of 2% potassium acetate containing 0.02% raffinose. The cells were grown for 3 days at 30° C. in a glass tube in a roller drum. Sporulation was confirmed by microscopy. An aliquot of 33 µL of the culture was transferred to a 1.5 mL microfuge tube and was centrifuged at 14,000 rpm for 2 minutes. The cell pellet was resuspended in 50 µL of sterile water containing 2 µL of 10 mg/mL Zymolyase 100T (MP Biomedicals, Solon, Ohio), and the cells were incubated for 10 minutes in a 30° C. waterbath. The tube was transferred to ice, and 150 µL of ice cold water was added. An aliquot of 10 µL of this mixture was added to a 12 mL YPD plate, and tetrads were dissected on a Singer MSM 300 dissection microscope (Singer, Somerset, UK). The YPD plate was incubated at 30° C. for 3 days, after which spores were patched out onto a fresh YPD plate and grown overnight at 30° C. The mating types of each spore from 8 four-spore tetrads were analyzed by colony PCR. A single 4 spore tetrad with 2 MATa and 2 MATα spores was picked and stocked as strains Y1661 (MATa), Y1662 (MATa), Y1663 (MATα), and Y1664 (MATα).

For yeast cell transformations, 25 ml of Yeast Extract Peptone Dextrose (YPD) medium was inoculated with a single colony of a starting host strain. The culture was grown overnight at 30° C. on a rotary shaker at 200 rpm. The OD600 of the culture was measured, and the culture was then used to inoculate 50 ml of YPD medium to an OD600 of 0.15. The newly inoculated culture was grown at 30° C. on a rotary shaker at 200 rpm up to an OD600 of 0.7 to 0.9, at which point the cells were transformed with 1 µg of DNA. The cells were allowed to recover in YPD medium for 4 hours before they were plated on agar containing a selective agent to identify the host cell transformants.

Host strain Y1515 was generated by transforming strain Y1664 with plasmid TOPO-Phase I disruption construct digested to completion using PmeI restriction endonuclease. Host cell transformants were selected on YPD medium containing 300 ug/mL hygromycin B, and positive transformants comprising the Phase I disrupting sequence integrated at the GAL80 locus were verified by the PCR amplification.

Host strain Y1762 was generated by transforming strain Y1515 with plasmid TOPO-Phase II disruption construct digested to completion using PmeI restriction endonuclease. Host cell transformants were selected on YPD medium containing 100 ug/mL nourseothricin, and positive transformants comprising the Phase II disrupting sequence integrated at the LEU2 locus were verified by the PCR amplification.

Host strain Y1770 was generated by transforming strain Y1762 in two steps with expression plasmid pAM404 and plasmid TOPO-Phase III disruption construct digested to completion using PmeI restriction endonuclease. Host cell transformants with pAM404 were selected on Complete Synthetic Medium (CSM) lacking methionine and leucine. Host cell transformants with pAM404 and Phase III disruption construct were selected on CSM lacking methionine and leucine and containing 200 ug/mL G418 (Geneticin®), and positive transformants comprising the Phase III disrupting sequence integrated at the ERG9 locus were verified by the PCR amplification.

Host strain Y1793 was generated by transforming strain Y1770 with a URA3 knockout construct (SEQ ID NO: 154). The URA3 knockout construct comprises upstream and downstream sequences of the URA3 locus (generated from *Saccharomyces cerevisiae* strain CEN.PK2 genomic DNA). Host cell transformants were selected on YPD medium containing 5-FOA.

Host strain YAAA was generated by transforming strain Y1793 with the Phase I marker recycling construct. Host cell transformants were selected on CSM lacking methionine and uracil. The URA3 marker was excised by growing the cells overnight in YPD medium at 30° C. on a rotary shaker at 200 rpm, and then plating the cells onto agar containing 5-FOA. Marker excision was confirmed by colony PCR.

Host strain YBBB was generated by transforming strain YAAA with the Phase II marker recycling construct. Host cell transformants were selected on CSM lacking methionine and uracil. The URA3 marker was excised by growing the cells overnight in YPD medium at 30° C. on a rotary shaker at 200 rpm, and then plating the cells onto agar containing 5-FOA. Marker excision was confirmed by colony PCR.

Host strain Y1912 was generated by transforming strain YBBB with the Phase III marker recycling construct. Host cell transformants were selected on CSM lacking methionine and uracil. The URA3 marker was excised by growing the cells overnight in YPD medium at 30° C. on a rotary shaker at 200 rpm, and then plating the cells onto agar containing 5-FOA. Marker excision was confirmed by colony PCR.

Example 2

Generation of Genetically Modified Sporulation and Endogenous Mating Impaired Haploid Cells This example describes an exemplary method for disrupting a sporulation gene and a pheromone response gene in a genetically modified haploid *S. cerevisiae* cell to yield a genetically modified haploid *S. cerevisiae* cell that is sporulation and endogenous mating impaired.

Figure 7:
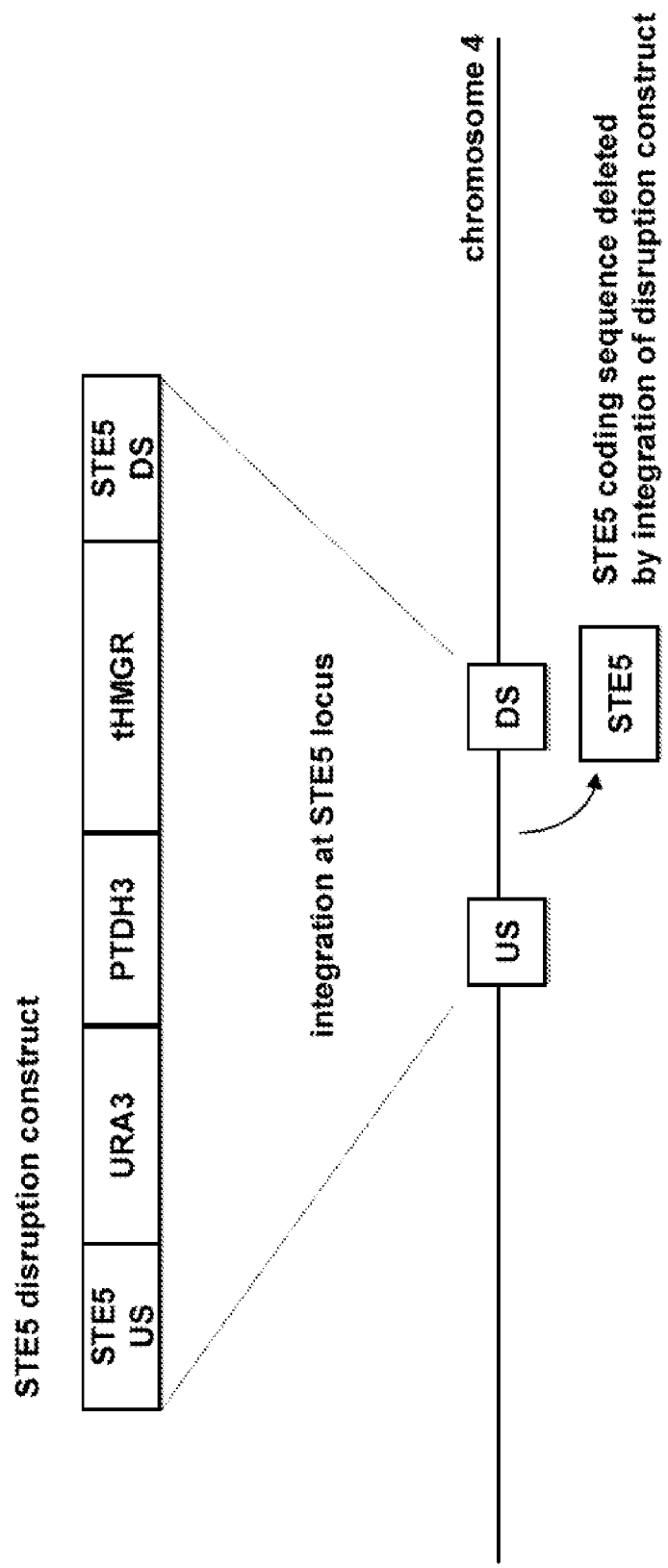
FIG. 7 provides the structure of the STE5 disruption construct and of the target locus after integration of the disrupting sequence by homologous recombination.

The STE5 disruption construct (FIG. 7; SEQ ID NO: 147) comprises as a disrupting sequence nucleotide sequences that encode a selectable marker (URA3, which confers the ability to grow on media lacking uracil); and an enzyme of the *S. cerevisiae* MEV pathway (the truncated HMG1 coding sequence, which encodes a truncated HMG-CoA reductase), under regulatory control of the promoter of the *S. cerevisiae* TDH3 gene; flanked by homologous sequences consisting of upstream and downstream nucleotide sequences of the *S. cerevisiae* STE5 locus. Upon introduction into a *S. cerevisiae* host cell, the STE5 disruption construct can integrate by homologous recombination into the STE5 locus of the *S. cerevisiae* host cell genome, functionally disrupting the STE5 locus by replacing the STE5 coding sequence with its disrupting sequence.

Figure 8:
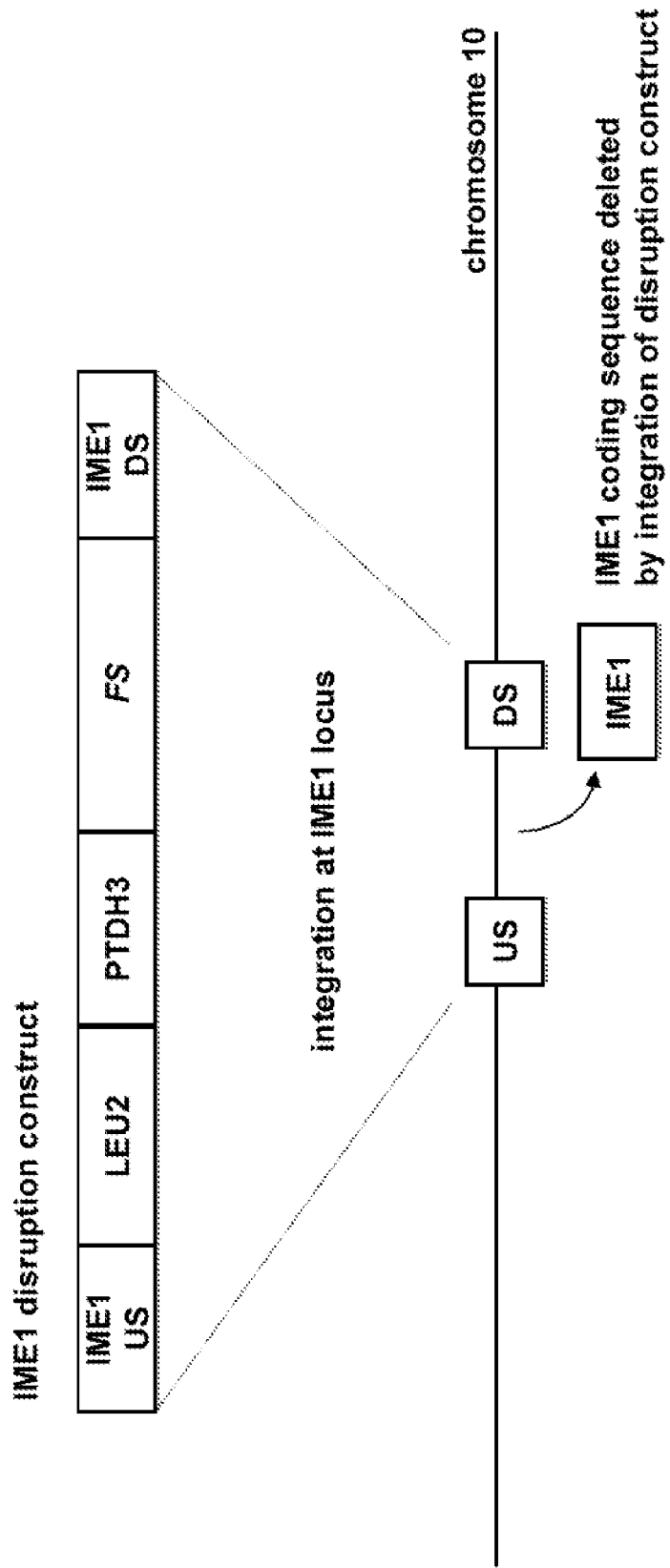
FIG. 8 provides the structure of the IME1 disruption construct and of the target locus after integration of the disrupting sequence by homologous recombination.

The IME1 disruption construct (FIG. 8; SEQ ID NO: 148) comprises as a disrupting sequence nucleotide sequences that encode a selectable marker (LEU2, which confers the ability to grow on media lacking leucine), and an enzyme of the *A. annua* (the FS coding sequence, which encodes a farnesene synthase), under regulatory control of the promoter of the *S. cerevisiae* TDH3 gene; flanked by homologous sequences consisting of upstream and downstream nucleotide sequences of the *S. cerevisiae* IME5 locus. Upon introduction into a *S. cerevisiae* host cell, the IME1 disruption construct can integrate by homologous recombination into the IME1 locus of the *S. cerevisiae* host cell genome, functionally disrupting the IME1 locus by replacing the IME1 coding sequence with its disrupting sequence.

Host strain Y1913 was generated by transforming strain Y1912 (see Example 1) with the STE5 disruption construct. Host cell transformants were selected on CSM lacking methionine and uracil, and positive transformants were verified by PCR amplification.

Host strain Y1915 was generated from strain Y1913 by curing the strain from pAM404 and transforming the resulting strain with the IME1 disruption construct. Strain Y1913 was propagated in non-selective YPD medium for 3 days at 30° C. on a rotary shaker at 200 rpm. Approximately 100 cells were plated onto YPD solid medium and allowed to grow for 3 days at 30° C. before they were replica-plated on CSM plates lacking methionine and leucine where they were grown for another 3 days at 30° C. Cured cells were identified by their ability to grow on minimal medium containing leucine and their inability to grow on medium lacking leucine. A single such colony was picked and transformed with the IME1 disruption construct. Host cell transformants were selected on CSM lacking methionine and leucine.

Example 3

Generation of Genetically Modified Sporulation and Endogenous Mating Impaired Diploid Cells This example describes an exemplary method for rendering diploid a genetically modified haploid *S. cerevisisea* cell that is sporulation and endogenous mating impaired.

Diploid host strain Y1979 was generated by self-mating of strain Y1915. To generate cells of opposite mating types and to transiently render strain Y1915 capable of mating, the strain was co-transformed with plasmid pAM1124 (SEQ ID NO: 149), which encodes the HO protein and the nourseothricin resistance marker; and plasmid pAM1758 (SEQ ID NO: 150), which encodes STE5 and the G418 resistance marker. Host cell transformants were selected on CSM containing G418 and nourseothricin. Positive transformants were replated for single colonies on a non-selective medium, and G418 sensitive, nourseothricin sensitive diploids were identified through screening using colony PCR.

Example 4

Confirmation of Sporulation and Endogenous Mating Impairment

This example describes exemplary methods with which to confirm the sporulation and endogenous mating impairment of genetically modified *S. cerevisiae* cells.

Figure 9:
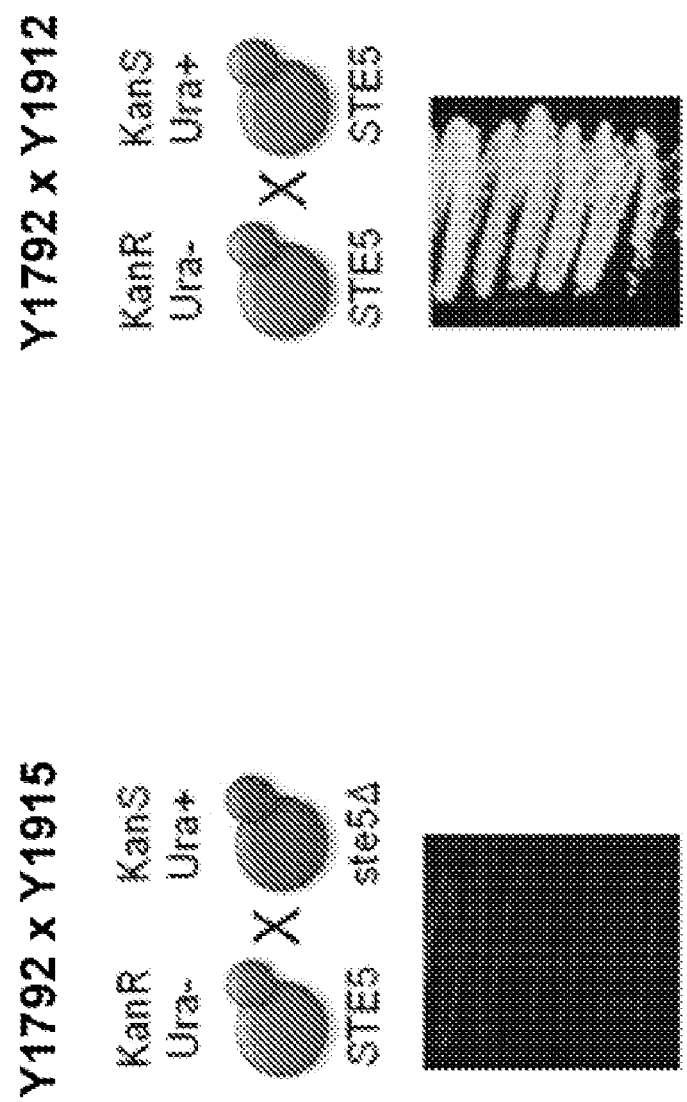
FIG. 9 provides a comparison of mating capability of genetically modified endogenous mating impaired haploid Y1915 cells and genetically modified endogenous mating competent Y1912 cells.

To confirm the inability of strain Y1915 to mate, haploid Y1915 cells (MATα $Kan^s$ URA3ˆste5) or haploid Y1912 cells (MATα $Kan^s$ URA3 STE5) were combined on YEPD solid medium with haploid Y1792 cells (MATa $Kan^R$ ura3 STE5). The mating cultures were incubated for 16 hours at 30° C. Identical aliquots of each mating culture were then plated on CSM solid medium lacking uracil and containing G418, and the cultures were incubated for one week at 30° C. As shown in FIG. 9, colony growth was observed only on plates containing an aliquot of the Y1792×Y1912 mating culture but not on plates containing an aliquot of the Y1792×Y1915 mating culture.

Figure 10:
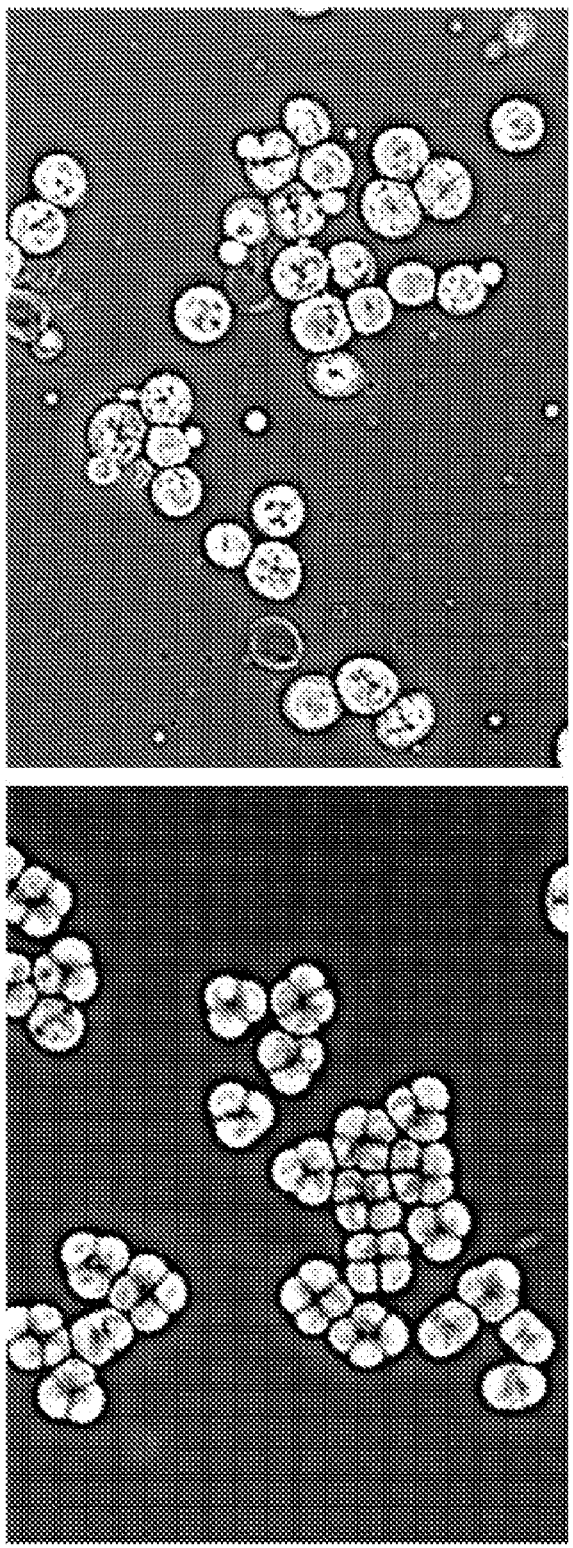
FIG. 10 provides a comparison of sporulation capability of genetically modified sporulation and endogenous mating impaired diploid Y1979 cells and genetically unmodified sporulation and endogenous mating competent Y1198 cells.

To confirm the inability of strain Y1979 to sporulate, strain Y1979 cells and strain Y1198 cells were cultivated for 7 days in sporulation induction medium (medium lacking a non-fermentative carbon source, e.g., potassium acetate, which induces native *S. cerevisiae* cells to abandon the cellular mitotic cycle and go into meiosis and sporulate). The cultures were then divided and treated for 15 minutes with water or diethyl ether. The suspensions were homogenized by inversion, re-suspended in sterile water, diluted, plated on YEPD solid medium, and grown for 3 days. As shown in FIG. 10, 95% of strain Y1198 cells formed tetrad spores under these conditions whereas strain Y1979 cells did not.

Example 5

Confirmation of Inability of Sporulation and Endogenous Mating Impaired Cells to Disseminate in Nature This example describes exemplary methods with which to confirm the inability of sporulation of endogenous mating impaired genetically modified diploid *S. cerevisiae* cells to disseminate in nature.

Figure 11:
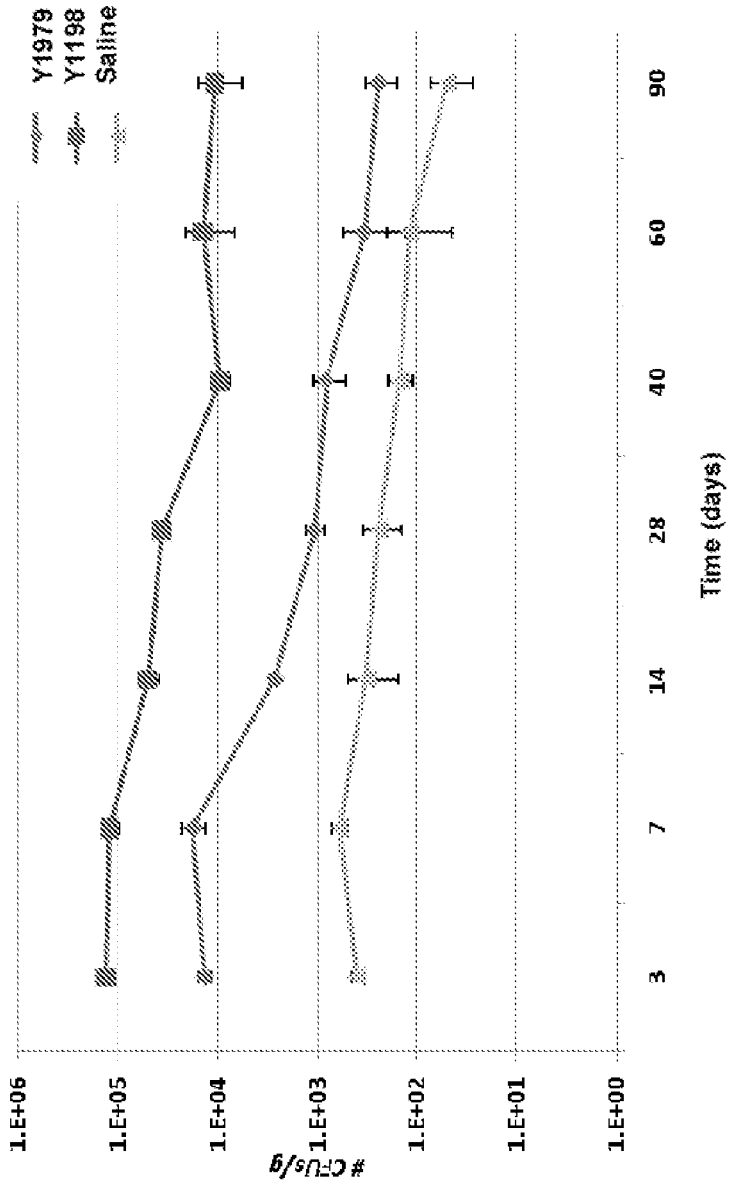
FIG. 11 provides a comparison of survival in soil of genetically modified sporulation and endogenous mating impaired diploid Y1979 cells and genetically unmodified sporulation and endogenous mating competent Y1198 cells.

The survival of Y1979 and its non-transgenic isoline, Y1198 (PE-2), in soil was assessed. To this end, 45 L flasks were filled with approximately 25% vermiculite and 75% soil from the cane field (total of 40 L) and planted with 1 *Saccharum* spp. cultivar RB 86-7515 sugar cane plant (approximately 6 months old). Each pot was fertilized with a dry Nitrogen/Phosphorous/Potassium mix of 5-25-30, and the plants were grown for 14 days in a containment greenhouse. To each pot was added 600 mL of cell suspensions of strain Y1979 or strain Y1198. The application of yeast cells is equivalent to attaining a concentration of $10^7$ cells/g in the first surface 5 cm of the soil. Five samples of 1.5×5 cm soil cores were collected at the following time points: t=0 (pre-exposure), 0 (post exposure), 3, 7, 14, 28, 40, 60, and 90 days (total volume of soil sampled was 44 mL, and total weight of soil sampled was approximately 50 g). From the composite samples, 10 grams were separated and resuspended in 100 mL of distilled water. To quantify yeast survival, 100 μL of the aqueous extractions were plated directly onto YPED medium (25 mL/plate), pH 5.5 adjusted with sulfuric acid 6N with addition of 0.05 g/L bengal rose (Sigma #R3877) and containing 0.2 g/L ampicillin (Sigma A0166). Samples were plated in duplicate, in dilution series from 1-$10^7$, or the number of dilutions to be plated was based on the counts of survival obtained in the previous samplings for each treatment. Immediately after the plating the liquid was spread with a Drigalski spatula. The plates were left open to the flow for up to 30 minutes for total evaporation of the liquid and were then closed, inverted, and incubated for 48 hours at 30° C. The colony number per plate was read using a colony counter (CP600 Plus, Phoenix), in countable dilutions, and the result was expressed in CFU/plate. Counts were considered only if the total number of colonies was between 30-300 colonies. As shown in FIG. 11 (each data point is an average of five repetitions), Y1979 cells were clearly less viable in the soil than the genetically unmodified and sporulation and mating proficient parent cells of strain Y1198.

All publications, patents and patent applications cited in this specification are herein incorporated by reference as if each individual publication or patent application were specifically and individually indicated to be incorporated by reference. Although the foregoing invention has been described in some detail by way of illustration and example for purposes of clarity of understanding, it will be readily apparent to those of ordinary skill in the art in light of the teachings of this invention that certain changes and modifications may be made thereto without departing from the spirit or scope of the appended claims.

SEQUENCE LISTING (156 sequences)

SEQ ID NO: 1 - DNA, 3083 bp, Saccharomyces cerevisiae
tgcactcaaaaaccttcttagttacaggaaaaggtaaagatacgataagaaaagcctttgaactgcccatcctgcatcctaacacagatctaactcactattcgggtaaggaagtgtcatgcatgtctgcaaagggactagaagaaagttacatgattacataagcaaaaaatcggaattacagacacaccattttttatcctgcggccccatttccgtcttcgagggaaaggatcaaaggcgcttagcccaatcttgatgattcaccggggaagaaaggaattacagaacccccagccacgtaacacagccaattagttttctatatcgggaaacgtgattgattgcgcaattttggctgcatcagaatacatcgatgagatctagagcaccctttgatggtttaagtccggtttaaagttagtagatcaatgatttcgtagtgcattttaaagggagcgcttatccatgggtgattgcgtttacaacgttttgtgtgtactcataatagccaatctaaaattaaacaacaacaacaacgcacaattaatatgtatcagccccaatacctttttctcttactgtaatttactactaaattggggtcggacgtttttgatcttgttccttgcctgttgtttaccttgtatattacttttcctcttttatgtatttaaggtaaattaattatcttttgatcttaatatttttctcaaaatgcttcccttgtagttcggtatttttgcttcttcagatatttaaactaccgtataccataactgtttcgtgaagtagatacaaacatcgactatcctattacgatttattttacattatcatattataaatcgaccagtagtattgttaaagattaaaagcataatatactactgtcattagtcacctacagagaaacaaattcctactggcacccattactggtgaaaaaggaaaaaaataataaaagaaaagcttttctattcctctccccacaaacaaaatgcaagcggatatgcatggaaaacttcacgctgccttagaagatggtttcttcctctttccttttgaacagcaacaacaacctaacatttattatgacacaaccaccgatcaagaagaccgtccttgtttttcttttggatctacaatttcccctagaagttggcattttgaaaagtctgacaaaattgcctcatctcagctgcagaacttggttcatacacaaccaattcatttaattaatcctcaaatattgttcaatgaagagtttctgaatttggaaaatattgattctcagcctatttccaaggaaacgaaaactacgaaggactgcacaatggcaactggtcctgaaagaggaaaaaagagctctgaaagtaccagatcctcttcattatcatctcttttttctaatgatgaatccgcatctacgttccactcatcattcaataaccatgataactttcaaaagagcaacagaaatggagatgatatcgatattagtgacacaataaaatatgaaactaatacaaatgcacaaaaagatatcaaaatattccaagaaaattttgaattcaatgaattcccatacacacaagacttctacccatataccactaattatacctattcaaaacccacaaatattcatgaatcaataaattcaaaaaacacggattcatactcccaatatcaagatcagtttccaccacatactgataacatacattcctttaataatcgtcactatagcaaccataaaagcactaattgtaattactataataataccagcaataataacaacgcctccgataatgtatatgaggcagatccatttatagatgaacctcaggtgccctcctactattacccattagaaattgccttcgacgttgaaaaatcaccaccgccatcactacaaaaattaaattcaaaagagttagaattcctaaaaaagttgaactccaaactgtcaagatatgctgcggcttactccttcagcagttctaatgatcaagattattatgacaaggtcaggtttcaagaaatatcctacaagtttagtaaaacctattcttaattctcgaaaagtactacaatcttcccccttccctcaaaatatatccattcacactcatttctttatttccattgtctcactcaaattgctaagaatttgtgtatttgcatatatatatattatatataggtatatatatgtattcaatgtctcaagctccatgacataataccgtagcgttattagccttatcgtatgtcgcgatgggaaaggagattcgttttaatcttgaaaaaccttcgtagcgaataatgcgacataaatcttgagagagtacatcaccaaattcactttgttaaaccgcaccatcgtgctttgcattcttattccttttgcctacactaaaattattagcatttctctaaatgagctccagtgaagacgaagacgacaagttcttgtatggttccgactccgaattagcactaccttcttctaaacgatcaagagatgatgaagcagacgcaggtgcgtccagtaatcctgatatagttaaaaggcaaaaattcgactctcccgtggaagaaactccagctactgccagagatgatcgttctgatgaagatatctactctgactcctcagatgacgatagtgattctgacctagaggttatcataagtctgggtcctgaccctactaggttagatgcaaaactactcgattcttattctaccgcagcgacatcttcaagcaaagacgtaattagcgtagctacagatgtatccaataccatcacaaagacatcagatgaaagactaataacagaaggagaagcaaatcaaggtgtaacggcaacgaccgtaaaagctacagagagcgatggaaatgtaccgaaagcaatgactggttctatagacctggataaagagggaatctttgatagtgttggcataacgacaatagatcctgaagtattaaaggagaaaccctggaggcaaccgggggccaacttaagtgattatttcaattacggttttaacgaatttacctggatgga

SEQ ID NO: 2 - protein, 360 aa, Saccharomyces cerevisiae
MQADMHGKLHAALEDGFFLFPFEQQQQPNIYYDTTTDQEDRPCFSFGSTISPRSWHFEKSDKIASSQLQNLVHTQPIHLINPQILFNEEFLNLENIDSQPISKETKTTKDCTMATGPERGKKSSESTRSSSLSSLFSNDESASTFHSSFNNHDNFQKSNRNGDDIDISDTIKYETNTNAQKDIKIFQENFEFNEFPYTQDFYPYTTNYTYSKPTNIHESINSKNTDSYSQYQDQFPPHTDNIHSFNNRHYSNHKSTNCNYYNNTSNNNNASDNVYEADPFIDEPQVPSYYYPLEIAFDVEKSPPPSLQKLNSKELEFLKKLNSKLSRYAAAYSFSSSNDQDYYDKVRFQEISYKFSKTYS

SEQ ID NO: 3 - DNA, 3938 bp, Saccharomyces cerevisiae
ccaatgccccactttttctcgaggagttgaaacaagcgggacaactgctacgtcataggaatgggagtaacaagggaggtgccataagccgggtaaaatttggcgctgttttccttaatctaaaaatagttcaacaaaaaaatttgggctccgcccatccagaccaaagcaatcttcggccttaacaagccaaagggaacgaaacccagactctaccatgcatttcgaacatcttgtagctaactacactggtaacccagatacctattctctcagtagctgtttcaccaagactccgcactcatggtaagtagaaaaagaaaactctcacaaaaatctgagtggcacagcttttctaaatacgctatttaaacttggagaaataaagatgtattacccgctggtgccttaaaatatccttttctccggttgtccaataatttatgttacggcggctatttgagtttttgtggaaatctctatcattaataaatgtcagccttgtgtcttaaatgcaattcaacagggaaaaggcgcgagacttcggcggcaaaaagccacagacaagtgctggttgcaaagaggtaaagaagtaatgagtgtaatcaaatagatatattaaggtagcaactcaccggtctgtccattttcttttcctgaataacttcttctgtcttcacacattcatttcatttttattttccaatatcactcaacgagaaagaagttacaagatctatctttcaaaatagtttacagttacctttactttaccctttcccttttcagtttgttaccccttctcctaaaagttttattttttgggtaaagatataaaggacactccagtcggttaaggtggctgtctagagaatataaacctgtatttatttaccaggcttatcagaaaagttaatcgtgttcttaaatatttattgaaaaggaacgtgatacagacgtaataaaagaagagtactaagcttaacttaataggtcatttatggttgaaaaacgtagtagacagagttccagtagtggctcacagttcagtgttccacctgatgtcgataacccgccactttctatccctttgaagactttatcagacagatatcagctgatcgaaaaactaggtgcaggatcatttggttgtgtaactttagccaaagcgcaatttcctttatcgaacatattgggtaaacaacatgatataaggggtactttaatggatcagcctaaaaatggtcaccaaaactatataacaaagacacaaggtgtagtggctataaagacaatgatgacaaaactgcatacactccaggattatacgagggtcagagaaattaagttcatactggcaatcccagcgaatgaccatctgatacaaatttttgaggtctttattgactctgaaaattaccaattacatatcgtaatggaatgtatggagcaaaacctatatcaaatgatgaaacatagaaggcgccgagttttttcgattccttctttgaaatctattctatcgcagatactggctgggttaaaacacatccacgaacataatttcttccacagagatttaaaacctgaaaatattcttatcacaccaagtacccagtattttgaaaaggagtacatgaaccagattggatatcaagataactatgtcattaaactggcagattttggtttggcacgccatgttgaaaataaaaacccgtatacggcctacgtttccacaagatggtatagatcgcctgaaatattattaagaagtggttactattccaaacctttggatatttgggcatttgggtgcgtggcggtggaagttactgtattcagagctctcttccccggtgctaacgaaatcgatcagatatggaaaattttagaagttcttggtacacctatcaaacgttctgattttgttaatacaaaccacatcacagctccaccacctggtggattttgggatgatgccagcaatttggtccataaattaaacttgaaattgccttatgtagaaggttcatcgttggatcatctactttctagctcccaactatccgatttatctgaggttgtcaaaaagtgtttaagatgggatcctaatgaaagggcaacagcccaagagctttgtgaaatgccattttttgaaaacaccgtggcatcccaagtagacgcaagaggcaatgtgactaatacagaacaagcattgatttttgcaggtataaatccagtggcgaccaacacaaagcccatatattttaactcttcaacaaaattgcccgcagaaacagagtctaatgatattgatatcagcaacaacgatcacgattctcatgctatgtgctcaccaacattaaatcaagaaaaactaactttggtagaatttttaaacgaattcgttgaagaagataatgatgatcactcaatacctgatgttggaacagattctaccatttcagattctattgatgagactgaattatcaaaagaaattcgtaataatttggccctttgtcaactaccagatgaagaagtcttagatcattcattatcgaatattaggcagttgacaaatgatattgaaattataaataaagatgaagcagacaacatggaacagctattttttgacctggaaattcctgaaaaggatgagtttcagagaaaacaaccatttaatgaacatgcagatattgatgaagacatcgttctaccatatgtgaacaactcaaattacacacatacagataggtcacatcatagaggtgataatgttttgggtgatgcctctttaggcgattcgtttaattcaatgccagattttactccaagaaatttcttgatacctacattaaaaaaatcacgggaaaagttcgagcctcatctatccaatccaaaccaacattttggaaatgtaaccttctaataatttgtcatttgactgacgaatcgttaggcacagttatatagttatatacacatagacatacatatgttcgcatatatattatattactatgcattcacctaaatagctactgctctattaatacagtgcttttttgatggctttaatttaacttattagacattactttgcgtttattcccctccaatatatttttatgtttgtttttcttgaacattttatgatttcttgctcttggcggctactgattttgttaagcaactcatcaagaggtcaaaaaaagtagaacgagatctttgtgttcggttacccggctcagatcctaacttcttcttttggtatgtttattcgtataagttactgttgtccacaggcaatactctgcagaaaattaaaacggcattaatgctaggacaaccagaattgttactactgtatgtgcgatagttgataactgcaacattatgcccggtatattctcaaaaaaccctattactgcatacgaagaaatcgcaagagaaatctttcggtttggaaaagctcactgtgaggttccttggagccaatagtaatacagcacaatccaaggaaaaatctggcctatatgcaaggaaggagagatagtcaaaagcattctttcccctagaagttggtgcatatatggcatcgttaaaacatattacccccaaaatttcttctctaaacgatgtgcttggcctttgttttggtttttgatgtcggtcgtttgaggccccttgcggaaaatcgagatcgccgaatggcacgcgagggaagggaaataaggtttaaaggcactgaaacaataggcaagaagtaggcgagagccgacatacgagactaatgtgtccgcgtttctaaggccacttttcaatgaaacggatattgatatgctagtaaaaggacgagctcaagagcgaaaatataagtaaagaattcgagtgcacttgtctccatgcagcaagatttcatatgagtc

SEQ ID NO: 4 - protein, 645 aa, Saccharomyces cerevisiae
MVEKRSRQSSSSGSQFSVPPDVDNPPLSIPLKTLSDRYQLIEKLGAGSFGCVTLAKAQFPLSNILGKQHDIRGTLMDQPKNGHQNYITKTQGVVAIKTMMTKLHTLQDYTRVREIKFILAIPANDHLIQIFEVFIDSENYQLHIVMECMEQNLYQMMKHRRRRVFSIPSLKSILSQILAGLKHIHEHNFFHRDLKPENILITPSTQYFEKEYMNQIGYQDNYVIKLADFGLARHVENKNPYTAYVSTRWYRSPEILLRSGYYSKPLDIWAFGCVAVEVTVFRALFPGANEIDQIWKILEVLGTPIKRSDFVNTNHITAPPPGGFWDDASNLVHKLNLKLPYVEGSSLDHLLSSSQLSDLSEVVKKCLRWDPNERATAQELCEMPFFENTVASQVDARGNVTNTEQALIFAGINPVATNTKPIYFNSSTKLPAETESNDIDISNNDHDSHAMCSPTLNQEKLTLVEFLNEFVEEDNDDHSIPDVGTDSTISDSIDETELSKEIRNNLALCQLPDEEVLDHSLSNIRQLTNDIEIINKDEADNMEQLFFDLEIPEKDEFQRKQPFNEHADIDEDIVLPYVNNSNYTHTDRSHHRGDNVLGDASLGDSFNSMPDFTPRNFLIPTLKKSREKFEPHLSNPNQHFGNVTF

SEQ ID NO: 5 - DNA, 3884 bp, Saccharomyces cerevisiae
atattgttttttccctagctgttttcggtttggttatgaacgcattgtctgcgaaaagaaacgtggataagtattatagaaacagcacttcttcggccaacaatatcacgcaaattgagcaagatagtgctataaaaggtcttttgcccttttttgcctattatgcaagcattgctttactagtgtggatgcaaccaagctttattacactctctttcatcctttccgttggtttcacgggagcatttaccgtcggaagaataatcgtttgccatttaactaagcagagctttcccatgttcaatgcacccatgttaattcctttgtgccagatagtattgtacaaaatatgtctatccctttggggaattgagtctaataaaatcgtctttgccctatcttggcttgggttcggtctctcactaggtgttcacattatgtttatgaatgacattatccatgaatttactgagtacctggacgtttatgctttatccatcaagcgctccaagctgacataaatcgcactttgtatctacttttttttattcgaaaacaaggcacaacaatgaatctatcgccctgtgagattttcaatctcaagtttgtgtaatagatagcgttatattatagaactataaaggtccttgaatatacatagtgtttcattcctattactgtatatgtgactttacattgttacttccgcggctatttgacgttttctgcttcaggtgcggcttggagggcaaagtgtcagaaaatcggccaggccgtatgacacaaaagagtagaaaacgagatctcaaatatctcgaggcctgtcctctatacaaccgcccagctctctgacaaagctccagaacggttgtcttttgtttcgaaaagccaaggtcccttataattgccctccattttgtgtcacctatttaagcaaaaaattgaaagtttactaacctttcattaaagagaaataacaatattataaaaagcgcttaaaatgaatgaaatggaaaacacagatccagtattacaggatgatctcgtatccaaatatgagagggaattaagcacagaacaggaagaggatacgcctgttatccttacgcagttgaatgaagatggcaccacttcgaattatttcgacaaaaggaaactaaaaattgcccctagatcaacactacagttcaaagtgggacctccatttgaattagtgagagattattgtccagtcgttgagtctcataccggaagaacactagatttacgaattattccaagaattgacagagggttcgaccatattgatgaagagtgggtaggttataaaagaaattattttaccttagtatcaacgtttgaaacggcaaattgtgatttggatacttttttaaagagcagttttgatcttctcgttgaagactcttcagtagaaagcagattaagagtgcaatatttcgctatcaaaataaaagctaagaatgacgacgacgacacggaaatcaatctcgtccagcatacagcgaaacgcgacaaaggtcctcaattttgtccttcagtatgtccgttggtgccttcccctttgccaaaacatcaaatcataagagaagcttcaaatgttcgaaatatcactaaaatgaaaaaatacgattccactttttatttgcacagagaccacgttaattatgaagaatatggagtggactctttattgttttcctatccagaagattctattcagaaagttgcccgttatgaaagagttcaatttgcttcatcaattagcgtgaagaaaccatcccaacaaaataaacactttagcttgcatgtaattttaggtgcagtggtagatccagatacctttcatggggagaatcccggaattccttatgatgaactggctttaaaaaatggatcaaaagggatgtttgtgtatttgcaagaaatgaaaacgcctcctcttattattagaggaagatcaccttctaactatgcgtcatctcagcgaataactgtgagaacaccgtcgagtgtcaattcctcacaaaacagcacaaaaagaaaaatgccatcaatggcgcagccgttaaatgaaagttgcttaaatgcaagaccttcgaaaaggcgatccaaagtggcgctaggtgcaccgaactctggggcctccatctcgcctatcaaatctcgtcaatccacaccaatggaagcttcgaaggaaaatgaggatccgttcttcaggccaaataaaagggtggagactcttgaacatatccagaacaaactgggtgctttgaaaaatcaatgtccagattcctctctgaaatatccgagttcatcttcaagaggtatggaagggtgtttagaaaaggaggatttagtttactcaagtagtttttctgttaatatgaagcaaatcgaactgaaaccggcacgctcttttgaacatgagaatattttcaaagtaggctcattagcattcaaaaaaatcaatgaattacctcatgaaaattatgatataacaatagagaagaaatcaatggaacagaattatctaagaccagagataggctcacgttctgaatgcaaaacaagctatggtaacgaactctccctttcaaatatttctttctctatactacctaactcagcagaaaattttcacttggaaactgcacttttcccagctacggaagaggatgtgccaaggacattttcaagaatattagaaacaggttcgtttcaaaattattatcaaaaaatggatgcagaaaatgcagatagggtatattcgaaaggggtcaagttgattgcaagcggtactctaccatctggtatatttaatagggaagaattgtttgaggaagatagtttctataagtattaaataaactaatgattttaaatcgttaaaaaaatatgcgaattctgtggatcgaacacaggacctccagataacttgaccgaagttttttcttcagtctggcgctctcccaactgagctaaatccgcttactatttgttatcagttcccttcatatctacatagaataggttaagtattttattagttgccagaagaactactgatagttgggaatatttggtgaataatgaagattgggtgaataatttgataattttgagattcaattgttaatcaatgttacaatattatgtatacagagtatactagaagttctcttcggagatcttgaagttcacaaaagggaatcgatatttctacataatattatcattacttcttccccatcttatatttgtcattcattattgattatgatcaatgcaataatgattggtagttgccaaacatttaatacgatcctctgtaatatttctatgaataattatcacagcaacgttcaattatcttcaattcggcttcagtactgtatgaaatactcgctaacattttctttattctataatagcacagtgacacttaaacgtcaaacgtggcgcacattaatatacgatgtatgcatttggcttgacactgctgtaataaggaacatcatcatccgtcaactagtagtcacattagtagtgtattatcacatggtgtgtaagaacattacgtaaagattgaaaaaaagtcatcaaaaataaaggaagctgaaacgcaaggactagtagtgtaatagaataatattgtgtaaaagtatcgataccctttttggaattattgtatcttcgagggtggcttttaatatatttttgaaaacctaatattataacctttcacaacaacgaaatcccaactgttgtgtaataattttactcaattcttactattgctttaccaatccttgtatttgagctctcataaagttcgctgactacttctcacgactcatgtcatc

SEQ ID NO: 6 - protein, 627 aa, Saccharomyces cerevisiae
MNEMENTDPVLQDDLVSKYERELSTEQEEDTPVILTQLNEDGTTSNYFDKRKLKIAPRSTLQFKVGPPFELVRDYCPVVESHTGRTLDLRIIPRIDRGFDHIDEEWVGYKRNYFTLVSTFETANCDLDTFLKSSFDLLVEDSSVESRLRVQYFAIKIKAKNDDDDTEINLVQHTAKRDKGPQFCPSVCPLVPSPLPKHQIIREASNVRNITKMKKYDSTFYLHRDHVNYEEYGVDSLLFSYPEDSIQKVARYERVQFASSISVKKPSQQNKHFSLHVILGAVVDPDTFHGENPGIPYDELALKNGSKGMFVYLQEMKTPPLIIRGRSPSNYASSQRITVRTPSSVNSSQNSTKRKMPSMAQPLNESCLNARPSKRRSKVALGAPNSGASISPIKSRQSTPMEASKENEDPFFRPNKRVETLEHIQNKLGALKNQCPDSSLKYPSSSSRGMEGCLEKEDLVYSSSFSVNMKQIELKPARSFEHENIFKVGSLAFKKINELPHENYDITIEKKSMEQNYLRPEIGSRSECKTSYGNELSLSNISFSILPNSAENFHLETALFPATEEDVPRTFSRILETGSFQNYYQKMDAENADRVYSKGVKLIASGTLPSGIFNREELFEEDSFYKY

SEQ ID NO: 7 - DNA, 3197 bp, Saccharomyces cerevisiae
aatgcccattatgccaataaagacttgccgctacatacggatttaccatttttagaaaatgtgccaggtttccagattctacaatctctacctgctacagaaggggaagatcccaatactagacccatgaattacttcgtggacgcattttatgctacccgtaatgttagagaatcggattttgaggcttatgaggctttacaaattgttcctgtaaattatatatatgaaaacggcgataagaggtactaccaatccaaacctttaatcgaacatcacgacattaacgaggacaatactcttctgggtaattatgaggccttgattaaatgcattaactactctccaccataccaagcacctttcactttcggaatttatgataagccctcagatctaaataataatctggacttgaatttaattaccaccccagcaaaactaacagagagatttttgtttaagtctttcattagggggttgaacttgttcgagagtcatatcaatgacttcaacaatcaatttagattgcagttgcccgaaaactgttgtgttatctttaacaacaggagaattttgcatgctaactctttaacaagctcaaaccagcaatggttaaagggttgctatttcgattctgatactttcaagagtaaattaaagttcttggaagagaagtttcctcatgacaaataacttcattttttcagcatagttatgtgattctttatatttatttattttctctctgtgtagtgacaattttttttttaatgtttcatgttaaatatatttattttaagaagccgtcagtttccttttgtttcattgaaatcaataactaaaattaaaattataaaaggaataacgtaaaagaaagtctactacccaaggaaaatctactttatttagtgattatatccaactaaatatcattcaaataacctcacatatttgtcttcacccttaagattttacgatttactaagttcaccttctcatggctttggagggattgcggaaaaaatataaaacaaggcaggaattggtcaaagcactcactcctaaaagacggtccattcacttgaactccaatggtcactccaacggaactccctgttcaaacgcagatgttttggctcatattaagcatttcctgtcattggcggctaattcattagagcaacatcaacagcctatttcaatcgtctttcaaaacaaaaaaaaaaaaggcgatacaagcagtcctgacattcacacaacattggacttccctttgaatggcccgcatctatgcactcatcagttcaagttgaaaagatgcgcaatccttttaaacttattgaaagtcgttatggaaaaattaccgctaggtaaaaacactacagtgagagatatcttctactccaacgtggaattgtttcaaagacaagcaaacgtagtccagtggctggacgttatacgctttaatttcaagctctctccaagaaaatccttaaacattataccagctcaaaagggtttagtttattcgcctttccccattgatatttatgacaatattctgacatgtgaaaatgaaccaaagatgcaaaagcaaacaattttccctggtaagccctgtctaattccatttttccaagatgatgcggtcatcaagttagggacaacaagtatgtgtaatattgtaatagtggaaaaagaagctgtcttcaccaaattagtaaataattatcacaagttgagtacaaataccatgctcattacaggtaagggatttccagatttcttgacaaggttattcctaaaaaaactagaacaatattgctccaaattgatatcggactgttctatatttaccgatgcggacccctatgggattagcatagccctaaattatactcactcgaatgaacgcaacgcttatatttgcacgatggcaaactataaaggaattcgtattacgcaagttttggcacaaaataatgaagtgcataacaaatccattcaattattgagtttgaatcagcgcgactactccttagccaagaatttgatagcatctctgactgccaacagctgggatattgcaacttcaccattaaagaacgtcatcatagaatgtcagcgggaaatttttttccaaaagaaagctgaaatgaacgagattgatgccagaatttttgaatacaaatgaataagaatgggagctgttgctttataaaaaatgtttttcaagaattgaaaacggttacatttaaatattatataaattgaaatctttgataatgaatactagtccaaaaaaaaatacaatttcaaaaaaataaatgccatctcctagaatcgaaccagggtttcatcggccacaacgatgtgtactaaccactatactaagatggcatatgattttacaatgattcgatggtgaatgagttataagccatgtaaggatcactagtcttttttcttaagtaactttttcgcttgtgatatcttgaaataccattaaacatagataagctattgaaatgtgaagaaaattcaaaaaaaaaagggaacagagtcatcttttgggtagaaactaagcttcaatggatgaatgtttacccaattcatgtctactaggtgttcacctcgtcatttcaacgcattcggggccacaaatagtttatcactacccaccctccaatacagcatttctaacaaataatccaacgaagcatcagcacctctatggaaaccatgcaaatctaaataaaaacacaagtacaaataaagaagaaaaactctttaattctggctctacgaaaacagcttctcaaattgctctaaacgagtcagcgaaaagttacaataccgctattacgccatcaatgacaaatactaatactaataatgtgacattacctccaactagatcgcatgctaatactgtaggatcacaaagttcaattcctgcggctactaatggtgtaggttatagaaaaaccgatatcgaagatacttctcggacttttcaataccaagaaactgaatctgaaacgtcatcatcgggattaagtgacagcgaattgtccacagactacttagacatttctagcgattcgttttctatatcttcttccttatcgtcatcttctttatcttcttctccctcaagttcatcctcatcttcccctccgcaagatggctta

SEQ ID NO: 8 - protein, 398 aa, Saccharomyces cerevisiae
MALEGLRKKYKTRQELVKALTPKRRSIHLNSNGHSNGTPCSNADVLAHIKHFLSLAANSLEQHQQPISIVFQNKKKKGDTSSPDIHTTLDFPLNGPHLCTHQFKLKRCAILLNLLKVVMEKLPLGKNTTVRDIFYSNVELFQRQANVVQWLDVIRFNFKLSPRKSLNIIPAQKGLVYSPFPIDIYDNILTCENEPKMQKQTIFPGKPCLIPFFQDDAVIKLGTTSMCNIVIVEKEAVFTKLVNNYHKLSTNTMLITGKGFPDFLTRLFLKKLEQYCSKLISDCSIFTDADPYGISIALNYTHSNERNAYICTMANYKGIRITQVLAQNNEVHNKSIQLLSLNQRDYSLAKNLIASLTANSWDIATSPLKNVIIECQREIFFQKKAEMNEIDARIFEYK

SEQ ID NO: 9 - DNA, 3194 bp, Saccharomyces cerevisiae
aaaaagccgtttgcggaaagcaatgttttgcccattcagaaacaatatctttgctgtatccctacatgtattatgccgcgttgcttgtgcaggtacggagtccctgcacgatttttcaacaaggtctagatttgctaagacgatgaggcggagcccgaaacaaacaagccaaaaaccggaatttcgcgcttggtgtgctttcgcatcttttcgtgtggtgaatgcacctggtgcacgctgcgaaggtgacgtagcaatccaaaaaagggaagtctaggcgctttcaaccgccccccaccgtgcatgcggattggttgtcacaattcgcagacatattggcaatgtttcctcccctcctgttgatgcgggtaaggggtgtctgttatgcaggaacaggaaggtaaaaattaaatgggccttaattctgtagacactctcttggggtaataaggttaaaagccattgttgaagtacggaatcatctcttcattttttcagcgcttgtaaggaattaatccccaggaaggtgccgatgtaatgagagaagtattcttgttgtatctctttggttcggagtatttccttctttcttttctttgtagtttttatgcaaatgcagggaacagagtacccggttaaggctgttagtcagccgcactctacacaaaattacttggcaaacacgttggttgggaaaagctttatacttggcggtgtagtaattgtaaaggatcaagattgtgtcatgctaatgtgccgctgtgtaacaacctttttgaagcgcgtatttaccaccggcaaaaggccattgtgtcacataaaaaaaaactcccgccaaagccaggttcattttgcataagattcaccacagtacggaaaatacgataagttaaccagtaatttgctcgctttagctactgataaaccttctctgttaacactattatttttttattactttagatttttccgtttgtgaatagccatttttagatatataatggggttcagaaaaatacttgctagcaaatcgcatcacagtcgccaccataatcagcaccataagaacctgaagttgcaaaatcatcgctatgtacttatttccaatattacaggatcccatgaaacaaaatatttatcacccttcaggatggacaattgttcaggaagcagaagacgtgataggctacatgtgaagcttaaatccttgaggaataaaatccacaaacaacttcacccaaactgtcggttcgatgacgccactaagactagtgatgataaatgcgtctcttatgaggtgcccgaaagggatggccttgctactatttcgttagaagaggtttttccaaagtccaacaggtgccaaatacctgaagaaaacttgggagaaacagatagcgttattcacagagatttgggaaattttgcaaatgagaatgactatccacagtggagaaaagttgaaagtcaatataacttagagaatgtccagcctgaggaggatgaaatagttgatagactcaggtccgagattagaagcactaaattaaaatctgtaaaaacgacaagcagaacacttgaaaaagctatagaggctcgatgtactggaaagagagttcttcaacaactaagttgtcagagcaaccaactcaccaagatcgagagcaattgtgacatgcttaaaattcaatctaacgtagccgaccgaaagattgacgaacttgcccatgaaaatagaagcctgcttgcattaaaatcacccaaccccttcaggaagaaaagggagagagaaaagcgagaccagatctacaatttgaagttaaagcatcgtcacttacagcaagaaactatgaaaagagcccaagattctgacaaaaatttagccataaatctaagttctgaatatggacggtatggccaaggggtggaaagacagcgtattcttagagatgcccagaagtatcagtttgaagccgatgaagaagataaccaaatggaaatcgacttgtacggaaacctagaacaaataaaagcggtgagtggtgacttgaaaattatggctcacgcttttggcagagagtttgaagcacaaaacactagaatgtttgacatcgagaacaatgtacagcaggcagataatgctttacaggccaagcgatatagattggagaaagtgatcgggaaaagatggtgatctgttatacacacaaaatatcgtgtataaatatattgaataaatagtttctaaaaaggcatacgcagatattcttgcgaaagagaaaaaaaaaagagcgagggggacattagtactgaaggtctcaattcttctttgtattttctttcggagttgtcagacaaagctttctctttcccataaataaagtgcattcaaacatcggcaggtttgtttttcccagttgttacgtatttgtttcccgttccattcatgatcttaaactgggttaactgaaaaatcaacatgattttgtgaaaagtaaaagagggtaagaaagatagataccgctgtcgtgggactatattttttacagtaccaagtctacttgcttctcataaagttgataagttataattcatataatttcatttgtcaaaaaagattttagttacaaaacgatatcaaagttcaatcttgttgggaaaaaggaaaacattatgaagggtttccggtaatcactgcgtatgccacactattcctatagaattgtcttgattgggtgcttatgctgcggaaaaattatattctgcgcttgccttttatattaagcgtcacaacgcccttaccaagatcgagcggattaagacaagaatgtatctcaagcgtccgtatatgtttaagttgaaaaggatatttagtaagaataattctaccctacaaacgatattagtaaaaaaaaaaatcaataatagagttattgtacaaacatgttctgaaaattggaagcatcacatcgtatgctactagagaaaatttttactatccttttttccacaagcccagccctagcccgatcatcctattaattgtcagaccaccgaatgctatcccgccacggttgatataacgaaactctttactgctttgggtcaaatatgcctcttttccgcattttttcggagtagttcattgccgcatacataccgcaacttggacgaggatgtcctccttctcttac

SEQ ID NO: 10 - protein, 397 aa, Saccharomyces cerevisiae
MGFRKILASKSHHSRHHNQHHKNLKLQNHRYVLISNITGSHETKYLSPFRMDNCSGSRRRDRLHVKLKSLRNKIHKQLHPNCRFDDATKTSDDKCVSYEVPERDGLATISLEEVFPKSNRCQIPEENLGETDSVIHRDLGNFANENDYPQWRKVESQYNLENVQPEEDEIVDRLRSEIRSTKLKSVKTTSRTLEKAIEARCTGKRVLQQLSCQSNQLTKIESNCDMLKIQSNVADRKIDELAHENRSLLALKSPNPFRKKREREKRDQIYNLKLKHRHLQQETMKRAQDSDKNLAINLSSEYGRYGQGVERQRILRDAQKYQFEADEEDNQMEIDLYGNLEQIKAVSGDLKIMAHAFGREFEAQNTRMFDIENNVQQADNALQAKRYRLEKVIGKRW

SEQ ID NO: 11 - DNA, 3875 bp, Saccharomyces cerevisiae
ttatttcaagcatttttggtgttgttggtgcgggtatattaaccctattgaacaataatgccaataactctgctcacatcggccttttgatattacctggcgttgctttcggtggtttggcacaaagttccatgctcgcttctcaaattcagttagacaagaagagcccaacttttcgatcagattttgtctctattaccacttttaacacattttgcaaaaatctaggtcaagcactgggaggtgtcatctctaacactgttttcagtgctgctgctatcaagaaattaaccaaggctaatattcagctcccagatggtaccacggtagacaatctggtaatctataggcagaccaatttcgatggctctcattccaaattgggcaatataatttctgaatctctcactgacgtcttttacatggcattaggattttatgcattatctctcatttttgctgtttttgcttcaaataagaaagtcacagcaagcctgagataagttaagcacgatttagaaggtggcgagcctcaaagtgtaaagctgcagaaaaaataaacatgacttttagtaattggctgtttagcttgctgaattgtgtaccacaactaacgataacagtaagagggtaatccgagacagtatgagtacagctattaaatagttaatttagatttttatactggtatgataaacgacgttcatatagcaagagcgtcaatgcctctatgtcaccttcaatagaagtttccctttttatttcgacttttgtttttgtatttttcggcgtctgccttgttccatttttaaggcgccaaaaataaaataaaatgatgaacgattagtactcaaagaacactttaatccttggaaacaaaaaaataaaaaatcaaaagttgaaggaaggtcaaattttcttcctccaacgataataatacttgcttatataactcttttaaagttttacaaaactttggatcagaaaaaaagaaaaaaatatggctactccccatttatatcacagatataactccaaaagctctaacaaaaatatcaattcgagcggaaattctacagaggttgaccgtttcattccaaaatcagtttcgagaaatgcttataagtctattccaatgttaaatgggtttgacataagttactcagaactttgcgagaaatctccttcacctgagcggctatcatcccctgaattctttaacgaactgcgaaacaccgggcattacgaatcaatcagtacaacaaatgagttttccatgtcaagtatctctagctcttctgagagtcaagttaccagaagtggaagtgcaagagcttcaagaaacgattattcaaaattaactaaagagcaaaaggaccatagaaagaatattgcacattctcttggttttcaattgcccgaccgtgtctttacgtttgagaccacaagtgctgaaattctggaaaagaataaagccatcaaaaattgctttggaccaggaagttgcgccgaaataagatcaacctttgactttagtacactctcgcccgatgttgcccgttattatatcgctaattctaacgcaagatcagcttccccacaaagacaaatccaaagacctgctaaacgagtaaagtcacatattccataccgtgtattggatgcaccttgcctgagaaatgatttttattcgaacttaatttcttggtcaagaaccacaaacaacgttttggtgggactgggttgctccgtatacatctggtctgagaaagaaggagcggtatctatattggaccatcaatacttaagtgaaaagagggatttagtgacatgcgtctcattctgtccttacaatacttattttattgttggtacaaaatttggccgtattcttctttatgatcaaaaagaattttttcattccagcaacacaaacgaaaaggaaccagtatttgttttccaaactgaatccttcaaaggaatatgttgcctagaatggttcaaaccaggtgaaatttgcaaattttatgttggagaggaaaatggcaatgtgagcctctttgaaataaagagtttgcatttccccataaaaaactggagtaaaagacaaaaactcgaagatgaaaatttaataggattgaaacttcattccacttatcaagctcaggcacagcaagtctgtggtacgttattaagagcttatgctttcacatacccttttctggtatagcgcttattttttcattatgaaaaatactaacaaatattttctacaggtatttctctgaatgaacatgcaaacctgcttgcagtcggcggcaatgataattcttgtagcttatgggatatttccgacttggataaacctattaaaaagtttgttcttccacataaagcggctgtgaaggccattgccttttgtccttggtcgaagtctttgttggctacgggtggtggaagcaaagacagatgtattaagttttggcatacatcgacaggcacattgttggatgagatttgcacctcgggacaggtgacgtctttgatatggtcgttgagacataaacagattgttgctacttttggattcggtgataccaagaatcctgtattaataacactatactcatatccaaaattatcaaaactactcgaagttaggtcgcccaaccctttgcgtgtactgagcgcagtaatctctccaagttccatggcaatttgcgttgccactaacgatgaaacgataagattttatgaactgtggaacgataaggaggaaataattaatgaaattcaagagagtgggatttatggatctaatattatagaatatatggagggtatcgaaacaacacataacaaaagaataaggtaatataaaaaaaggatattcattgcacgcacaaaccaaatacttcaaatagcaaactaacagtaagaatatataaaactatacatacgtatacataaaaaaataatagggaaaaaaaaaggaaaccatatgagtttgaatgaggcgacgtgccatattaaacaattatattttaacacttccgcactgcacctatttagttggctgatttgtgacgtttttaattccgatcggcctgaaacagcgaagggtcctggaaaattaagataataaaacgaaatgaaacccagcaacgttagatgatgctcaaaaaaatatagagacagagaaaaaccagaatacaaagagctgtttaagtggtcaatatcccaggtacaccgagcccagtcacatcgaacttataatggatgcaaagaaaaatactggtgaagccaataatgatgtattggaagaggaagcagcgattcagttgattgcaccaggtatagcgagaaacttaacacaagaagtcattaccggtatcttctgtaatgtagtaatatatcctcttcttctaatatattttgtcttaactttccgttacatgactacaaatattgtaccttatgaatttatagatgaaaagtttcacgttggccaaactttgacctatttaaaaggtaaatggactcaatgggaccctaaaataacaaccccccctggaatctatattttgggtttaattaattattattgtataaagcccatattcaagtcgtggagcacactaaccatactaagattagttaatttacttggagggattatcgttttccccattttagtactcaggccaatattcctttttaatgccttaggtttttggcccgtttcattaatgagcttcccattgatgacaacttattattacttattttacaccgatgtgtggtctacaattctgatattgcaatcactcagctgcgtgttaacattaccgtttggccccgtgaagagtatatgg

SEQ ID NO: 12 - protein, 593 aa, Saccharomyces cerevisiae
MATPHLYHRYNSKSSNKNINSSGNSTEVDRFIPKSVSRNAYKSIPMLNGFDISYSELCEKSPSPERLSSPEFFNELRNTGHYESISTTNEFSMSSISSSSESQVTRSGSARASRNDYSKLTKEQKDHRKNIAHSLGFQLPDRVFTFETTSAEILEKNKAIKNCFGPGSCAEIRSTFDFSTLSPDVARYYIANSNARSASPQRQIQRPAKRVKSHIPYRVLDAPCLRNDFYSNLISWSRTTNNVLVGLGCSVYIWSEKEGAVSILDHQYLSEKRDLVTCVSFCPYNTYFIVGTKFGRILLYDQKEFFHSSNTNEKEPVFVFQTESFKGICCLEWFKPGEICKFYVGEENGNVSLFEIKSLHFPIKNWSKRQKLEDENLIGLKLHSTYQAQAQQVCGISLNEHANLLAVGGNDNSCSLWDISDLDKPIKKFVLPHKAAVKAIAFCPWSKSLLATGGGSKDRCIKFWHTSTGTLLDEICTSGQVTSLIWSLRHKQIVATFGFGDTKNPVLITLYSYPKLSKLLEVRSPNPLRVLSAVISPSSMAICVATNDETIRFYELWNDKEEIINEIQESGIYGSNIIEYMEGIETTHNKRIR

SEQ ID NO: 13 - DNA, 2727 bp, Saccharomyces cerevisiae
caaaaaatgtatacaaactcttaggattggtcaagaaaagtaaatgttgtactgctccaaagatattgcgatgccgtgataattcaaaagggtcgacccagtctatttcactcgcgcgataatcgttcgttatccgaagctggccaattgatacaattaattgacatcagcagacagcaaatgcacttgatatacgcagcttaaagcaagggtaaattatctgaaaaaggattgaatacaatcaaaaccttcacatacattggtagtaatatcgagcatcgctattagcagagtatctcgaagtctaccacggcgaaagttgattttttatctgaggtgctgatcttcggacgcaatgcgcaaacgtaattccgtagttttcccaattattttattttttaaattacacgtaccaggtagatcacatacatatacccaacacctgttatatagtgaattgaattattcggaacatcaataatcctttgcttataattcttgttatcatccatcttgcatctttatttaattatattttgcacaataagctatctatgtgagctgcgtacggtgactccaaacaatctgttaatttccatataaataacttgtagtcggatcgtacaatggctctatataggtttggaccggtatgtaacctaatatggctgactcaaaacctgctagatagttatccaagtgaatttgagtctcgtatcctttatcacatttttacaatagtggctagctatctttttcatgttaggctcacccggtattctcatgcaagatcaaacaaaaaatggtaaagttttggactttacattgcttacagttgcttttttatgaagattcaaaagattatgtcctcggcggctaaattttccattaataatattatccttttacgcgaccgaaaaagagaagcgttttaagagttgtttctaacaaatattaataataaagctaacgtgaactgaccaggctctatttgaaagatatggcaccgaaaaagaaatcaaacgatagagccattcaggcaaaaggctcagaaggttaagtatttttttacatgctcatcaaataccgccattactaacaattgtaccccgggtattttatcagctgaacaattaatagaagattacttggtgtcacaatataaaccattttctgtaaatgatatagttcagaatttgcacaataaagtgacaaaaacaacagcaaccaaagcattagaaaatctcgttaacgagaaacgcatagtgtctaaaaccttcggaaagattataatttactcttgtaatgaacaagatacagcattaccaagcaatattgatccttctcagtttgattttgaaactgtattgcaactgagaaatgatttaatagaactagagagagataaatcaacggccaaagacgctcttgactctgtaactaaagaacctgaaaatgaagatctcctaacaatcattgaaaacgaagaaaacgagttgaaaaagattgaatcaaaattacaaagtctacaggatgattgggatccagcaaatgatgagattgtcaagcggataatgtctgaagatacgctgctacaaaaagaaatcacgaagagatcaaagatttgcaaaaacctaattgctacaataaaggactcagtgtgcccgaaaaatatgaatgaatttttggtatgtattttgaacatttttcgagaccttttcttttgaatatactaacgaaatctttacaggaagaaattggatttgaggacatttgatgtgaaaagcaattggttgttccgtaccggaacacttgctattttacttatcatgattgtttttttttcttattctttgctattattatcaaattatatataggtaaataatcttacactagtttataagtgtcacgaacgatgaaatggaaacttgggggggaaggctcaaaaaacatactgtgtgtttatggggctgcctttgctagttgttgaggggtgagaaccgcaattactgacaaacgttactgatttgtaatattcaaaaactccttgcattgccttcccgttggccaaaatagtagtcgttgacaaagagtacggcgtcgattctaaagttggtgaggggatttgctcgcatatagttgtcagttcctgtgctaaaactgaagcaataacagaaaatattgaaaaacagcgaagtaactgcatcttaattgaaaatgtatgaagtaggtataatattttggcacacaagtgactgttgagagcttacaatcattctagaatgaggaatacgtcaaaatggaaacttaacatatcacctcttcttacaactatttatattgtatatttacaagggaaatcaattgcctgatattcagtatattggatctgaaggtatgaaacagtcccttaattaagctttagatgcggacagaagtttttttgttaaacttgcatgtcaaatttcaaactgcgtgtaattaccgtattcggaaattacatggtttcagtaattttgcaataaacgcagcaaccggtgatggcgaagttttaccatcaaacaataacttataataactgaatgccggcaggttgaaacaaattcttgaaaattagtcatttattctattgtgcgaatgtaatccactgaaatcatctaaagcaccattaccattgtctagcctgtgaataaaaaaatatgggagtataatgatagagaagtg

SEQ ID NO: 14 - protein, 218 aa, Saccharomyces cerevisiae
MAPKKKSNDRAIQAKGSEAEQLIEDYLVSQYKPFSVNDIVQNLHNKVTKTTATKALENLVNEKRIVSKTFGKIIIYSCNEQDTALPSNIDPSQFDFETVLQLRNDLIELERDKSTAKDALDSVTKEPENEDLLTIIENEENELKKIESKLQSLQDDWDPANDEIVKRIMSEDTLLQKEITKRSKICKNLIATIKDSVCPKNMNEFLVCILNIFRDLFF

SEQ ID NO: 15 - DNA, 3830 bp, Saccharomyces cerevisiae
ggctgtctttattgttcgtggtactttggttggccggcgatgtctttaaccttatgggtgccgttatgcaacatcttttgtctaccatgatcattcttgctgcttactatacggtggcagatatcattttactaggtcaatgtctatggtacgataatgaggaaaaaccagcagtagaccctattcatctctcccctgccaatccaataaacgaaaacgttctgcacgatgtgttcaatgaacaacaaccgcttttgaattcccaaggtcagccaaatcgtattgatgaagaaatggctgctccttcatccgacggaaacgctggtgatgataatctccgtgaagtcaattcaagaaatttgataaaagacatatttattgttagtggtgtagtttttgtaggtttcatctcgtggtatgtaacctactgcgtaaactacacgcaacctcctcccgtggaggatccatcactgcctgttcccgaactgcagatcaattggatggctcagatattcggttacttaagtgcccttttgtatctgggttcaagaattcctcagatattactgaattttaagagaaagtcttgtgaaggtatcagtttcctattctttttgttcgcctgtttgggtaataccacatttattttctctgtgattgtcatttctttagactggaagtatctaattatgaatgcttcctggttggttggaagcataggtactttattcatggatttcgtcatattttcccagtttttcatttacaaaagaaataaaaaatttatactgaattaacatgttctatctaatatttatttaacatatttttgacctcacaaactttttttttttttctctctgtcattgacatttttttaatgtcacaaaaagaaaaattaaatgtattataaaatttcatttaaataggaaaaaacccgtgattactaaaggcatattaaagatctattaaagatctattaaagctttctgctaccagtatggataatattttaaaggcatcaaatatggaagggacttcaacaatgacagttacctcgcgtagttctgaagactctagttgtatctcaaatcatgaacaagataccgatacacataaggacggcgacacaagtggtctggaaaacagtaaaatttcgaagagaaagtggatgaaagagttttttaaactttccaaatctccagcttccaaaagcagccggagtataggttccatgaaaagtaaccagagcctcgtttcaatgaaaagtagtgacgatggcaacagttataaaaatgattactcttctatctgtggtaacagccttccatctgcaggcttgagtcgttcgaatagtgtgaaagaattaaaattagattcaactggaagtcagagatcaaaaaataatgttgccatgttagcacgttcttctacaacatctcagacaacgtgctcttcttcttcatcatcatcttcttataactctataaaaggaaatgaaaatgatattttattgcagaataacaatcactttaggcataacaaagaaattcctcaaagtaaagggagctccaacattaacaccgcatcgattatgagccaatacaatgtcgatacgcaagcaaccgctataatgagcgatatgcaaaagcaatacgactcgcaacagatgacatcaccatttgtaaacgaagacttgcatttcgatccaaatggtgaagtttcacacgtaataaaagcaatttttaaagaaattggttataaatacgatgatttcagtgatattcctgtttttcaattaatgcaagaaatgtatcaactagtgaagaagaattccagcgctagaagaacaaagataacagactatgcctctaaacttaaagaaaaagaagcgcaattaaaaagtcaaaatgacaaaattttgaagttagaaacaacaaacaaggcctacaaaactaaatacaaggaggtctctctggaaaataagaaaataaaagaggctttcaaagaactagacaatgagtcatacaatcacgatgaggaattactaaaaaaatacaaatatactagggaaaccttagatagggtcaatagagaacagcaattaatcattgatcaaaacgagtttttgaagaaaagtgtcaatgaactacaaaatgaggttaatgctaccaacttcaagttctctttatttaaagaaaaatatgcaaaattagctgatagcatcactgaattgaatacctctacgaaaaaaagagaggccctgggagaaaacttaacttttgaatgcaatgaattaaaagaaatatgtttgaaatacaaaaaaaacatcgaaaatatatcaaataccaataagaatttacaaaattcgttcaaaaatgaaaggaaaaaagttttagatttgagaaatgagagaaatttgttgaaaaaggaaatactgttgattgaatgtcatggttcatattctctactccttgtatctaatattctgacatgttatcggttcttactgccaagtgatactattattgaaactgaaagcttaattaaggagctactcaacatgaataattcactttcgaaccatgtgtcttcttctgacgagcctccagcggagtactcgaaaagattagaattaaaatgtgtagagtttgaggaaaagttactttatttctatcaagaacttgtgacgaagaaaattatagacgtcatttacaagtgctttattaattattacaagaaaagtaggcaaactgaccaaaaatccaatcagaactccagcactccgtataaacaaagccaaagacaagttccgcactccatcaagtgaacctcaacagctacacattcttttataatccttaatattctatatatacatatatgaaaaaatagaaaacgcgaaaacttgtcattttttttttaggcgtttttataatatactgaaaataaaaagaggctctttaaatgttgacactctactccaatatcaactgtaaaaaatctctttatctgctgacctaacatcaaaatcctcagattaaaagtatgtcctccactaggccagagctaaaattctctgatgtatcagaggagagaaacttctataagaagtatacagggttgccgaagaaaccattaaaaaccattagattagtggataaaggcgactattacacagttataggttcagatgcgatatttgtggcagattcagtctatcatactcaatctgttttaaagaactgccaattggaccctgtaacggcaaagaacttccatgaaccaactaaatatgttactgtttcgctacaagttcttgccactctgctgaagttatgtttgttggatctgggatataaagttgagatatacgataagggttggaaattaataaaaagcgcatctccagggaacattgagcaagttaatgagctaatgaatatgaatattgattcgagtatcatcattgcaagtttgaaagttcaatggaattcccaagatggaaactgcattattggagttgctttcattgataccactgcatacaaggtgggaatgcttgatattgtcgataatgaagtgtattccaacctagagagtttcttgattcaattgggtgtaaaggaatgtttggtgcaggacttgacatcaaattcaaactccaatgctgaaatgcagaaagtaataaatgtaattgatcgctgtgggtgcgtcgttacattattgaaaaactcagaattttctgaaaaagatgtcgaactggatttaaccaagttactgggcgatgatttggcattatcgttaccacaaaaatactctaaattatc

SEQ ID NO: 16 - protein, 609 aa, Saccharomyces cerevisiae
MDNILKASNMEGTSTMTVTSRSSEDSSCISNHEQDTDTHKDGDTSGLENSKISKRKWMKEFFKLSKSPASKSSRSIGSMKSNQSLVSMKSSDDGNSYKNDYSSICGNSLPSAGLSRSNSVKELKLDSTGSQRSKNNVAMLARSSTTSQTTCSSSSSSSSYNSIKGNENDILLQNNNHFRHNKEIPQSKGSSNINTASIMSQYNVDTQATAIMSDMQKQYDSQQMTSPFVNEDLHFDPNGEVSHVIKAIFKEIGYKYDDFSDIPVFQLMQEMYQLVKKNSSARRTKITDYASKLKEKEAQLKSQNDKILKLETTNKAYKTKYKEVSLENKKIKEAFKELDNESYNHDEELLKKYKYTRETLDRVNREQQLIIDQNEFLKKSVNELQNEVNATNFKFSLFKEKYAKLADSITELNTSTKKREALGENLTFECNELKEICLKYKKNIENISNTNKNLQNSFKNERKKVLDLRNERNLLKKEILLIECHGSYSLLLVSNILTCYRFLLPSDTIIETESLIKELLNMNNSLSNHVSSSDEPPAEYSKRLELKCVEFEEKLLYFYQELVTKKIIDVIYKCFINYYKKSRQTDQKSNQNSSTPYKQSQRQVPHSIK

SEQ ID NO: 17 - DNA, 4754 bp, Saccharomyces cerevisiae
atttcaaagcagtttgtgcaatttgtccagcagttctgtatttgttcaagaccgattcctgtagaatatttttgtcctttagcaaaatctgagtatcctcgtgggagatagctagagccatgatagttttagcaatattagtcgggtcgggttttttcttaaaagtattttgaataacacgatgctttagctcatctcatctcttctgctgaaatttttctttacttcggtaaaattttttcagaaagaaaaaaaagcttcagaggcatgaccctctccgggtaaaaaaagcttagggttaccggcctgtcatttttagggcataataaatttttgccatctagttgcaactataataatacagtatgaattgcacgaaagagcagtcaatgtaaattcacgaagtgactgacagaatactgacatcagctgatttctcatggagctgtttctctgataacacgttgtttgaacatcgacaagatgaaaatctagaagtatcaagtttcctttaaagggatatataacagattctaaaactgacagaaatatttcgagtgaagaagaagcgttaaatattggatctttccgcagttctactctgatacatttttgaagtaggagagtcatttagaaggcgtattgctcaatagtagaaagcaggcctgtgcacatgaattaattaaaaaatataaaggtagtgattagacgacacatgtccataggtaacctgtcataattttgaacaatttcccttcttttctttttttttttttgggtgcggcgatatgtagcttgttaatttacacatcatgtacttttctgcatcaaaatatgaaaggcgatagtagctaaagaaaataccgagaatttcctcgaaaagttgacgacaaaagaaaggcataaaaaagtaatttgaaaatattttaaaactgttttaacccatctagcatccgcgctaaaaaaggaagatacaggatacagcggaaacaacttttaaatgatggaaactcctacagacaatatagtttccccttttcacaattttggtagctcgacacaatatagtggtaccttgtcgagaacgcccaaccaaataatagagctagagaagcccagcactctatctccattgtcaagaggaaaaaaatggacggaaaagttagccaggttccaaagaagtagtgctaaaaagaaaagattctcaccttctcctatttcctcctctacattttcgttctcacccaaatctagggtcacttcttcaaactcttctggcaatgaagacggtaatctaatgaatacaccttctacggtttccactgattatttaccacaacaccctcacagaacatcgtctttgccaagacctaattccaatctctttcacgcaagtaatagtaacctatcccgagcaaatgagcctccaagggccgaaaatttatcagataatataccacccaaggtcgctccatttggctatccaatacaaagaacctctattaaaaaatcctttttgaatgcttcttgtacgttatgtgacgagcctatttctaacagaagaaagggagagaaaattatagagcttgcatgtggccacttaagtcaccaagaatgtcttattatctcttttggcaccacttcaaaggcagacgttcgtgcgctatttcctttttgtaccaaatgtaaaaaagatactaacaaagccgttcaatgcattccagaaaatgatgaactaaaggatattctaatttctgattttttgattcataagattcctgattctgagttatcaatcacacctcagtcccgctttcctccttattcaccactcttgcctccttttggtttatcctatacacctgttgaaagacaaacgatatattctcaagctccaagtctaaacccaaatctcatattggctgcaccccccaaggaaagaaaccaaattccacaaaaaaaatcaaactatacatttttacattcacccctggggcacagaagaattccgtccggagcaaactctatcttagcagacacctctgtagcgttatcagctaatgattctatttctgctgtttccaattcggtaagagcaaaggatgacgaaaccaaaataacgttgccgctgttaaggtcatattttattcaaattcttttgaacaatttccaggaagaattgcaggattggagaatagacggggactatggattactaaggttggtagacaaattgatgatttccaaagatggtcagagatatatacaatgctggtgtttcttatttgaagacgcatttgtaatagcagaagtggataacgatgttgatgttttggaaactagactaaagaatttagaagtatttacacctattgccaacttgagaatgactacactcgaagcttcagtactcaaatgcaccttaaataaacaacattgcgccgatttatcagatctttacattgttcagaatataaattctgacgaaagcacaactgtacagaaatggatatctggtatattgaatcaggattttgtattcaatgaggacaatatcacttccaccctgcctattcttcccattataaagaacttttcaaaagatgttggtaatggtaggtacgagacgagtacctttctaggtttaatcaatcctaacaaagttgttgaagttgcaaatgtgcacgataatgatactgtaatcataaggaggggattcaccttaaattcaggagaatgttctaggcagagtactgttgacagtatacaatctgttctaactacgataagctcaattctttccttaaaacgagaaaaacctgataatttggcaataatcttacagattgactttacgaaattgaaggaagaagacagtttaattgttatttataacagcctaaaagctttaaccattaaatttgcgcgtttgcagttttgtttcgttgatcgaaataattatgttctggactatggatcggtattacacaagatagattcactagattccatctcaaatctcaaatcaaagagttcctcgacacaattttcacctatttggctgaaaaatactctatatcccgaaaatattcatgaacatttgggtattgttgctgtatcaaatagtaatatggaagcaaaaaaatccgtactatttcaagattacagatgctttacaagttttggaagaagaaggcccaatgaattgaagattaaggtgggctatttgaacgttgactacagtgataaaattgatgaactagtcgaggccagctcctggacttttgttttagaaactctttgctacagtttcggtctaagttttgatgaagatgatgacgatgacgaagaggataatgatgattcgaccgataatgaacttgataatagttcaggattactgtcggatgctgaatctacaaccactattcatattgactctccatttgataatgaaaatgctaccgcaaatatggtgaatgacagaaaccttctcactgagggtgaacatagcaatatagaaaacttagaaactgtcgcttcttcagtacagccagctctgattcctaatattagattttcacttcattctgaggaggagggtactaatgaaaatgaaaatgaaaatgatatgccagtattattacttagtgatatggataaaggaatcgatggcataaccagacgcagttcattctcgagtcttatagagagcggtaataacaactgtcccctccatatggattatatatagagtatacactaaattttatgcaataataaaaaggaagcatcccgccaaacgtttcttaactatatattgttacatagcttgattccgtgaatttgaagtggacgcagttcttcttagtctttcaagttcatagtaaatagacattacccaaagatctctttcctgtcttgatcttgccatgaaaaccattgacttgccgctcacacctaactttttagtgaaatggatcttatctgtgttacttggaacattagtgttattcaagtcagcttccggagcagaaggtgggtcaatattattatcttgtctaccataatcttgcgtatattgcttttcattccctttcttctgtaagcgattgctagaaagggcacgccttgttccaaaccaaagcgtaaagcatcgcgaactctcgtcttctacagatcgccatccgtccccataaactcgtgggagagcgtgggatccatagtttatttcgtcaaaagtacgatctctctgcagaaggtctagttctgttgtggtcccagagtataggtagcaatcgtcaatcggaatggttacataatgagcatactccaaaacttccttagcaaaacctgtggttgatctatgaaagcagtggaacagtacaataaaacctgatatcaaaacgacgtagtacttcgagaaaacagaatgcttgtgcggcttttgatataaaggtcccttttgaattaacggcctacttaatgatattccatttgcattaaaggtttgctcatctgcacgcccatgttctacgatccagcgcaatgtattctcaccaatttttgtttcctcttctccatttagcatcaaaagacctgcatttgaacgccttatttttaaaagcctctccgtatcttccctttgcttgtttttccaataggatatcatttgtttcagctttatgacccactcttcagcaactgttgctgatgtagcaagcagcttcaagaggagtccatttgaggtttct

SEQ ID NO: 18 - protein, 917 aa, Saccharomyces cerevisiae
MMETPTDNIVSPFHNFGSSTQYSGTLSRTPNQIIELEKPSTLSPLSRGKKWTEKLARFQRSSAKKKRFSPSPISSSTFSFSPKSRVTSSNSSGNEDGNLMNTPSTVSTDYLPQHPHRTSSLPRPNSNLFHASNSNLSRANEPPRAENLSDNIPPKVAPFGYPIQRTSIKKSFLNASCTLCDEPISNRRKGEKIIELACGHLSHQECLIISFGTTSKADVRALFPFCTKCKKDTNKAVQCIPENDELKDILISDFLIHKIPDSELSITPQSRFPPYSPLLPPFGLSYTPVERQTIYSQAPSLNPNLILAAPPKERNQIPQKKSNYTFLHSPLGHRRIPSGANSILADTSVALSANDSISAVSNSVRAKDDETKITLPLLRSYFIQILLNNFQEELQDWRIDGDYGLLRLVDKLMISKDGQRYIQCWCFLFEDAFVIAEVDNDVDVLETRLKNLEVFTPIANLRMTTLEASVLKCTLNKQHCADLSDLYIVQNINSDESTTVQKWISGILNQDFVFNEDNITSTLPILPIIKNFSKDVGNGRYETSTFLGLINPNKVVEVANVHDNDTVIIRRGFTLNSGECSRQSTVDSIQSVLTTISSILSLKREKPDNLAIILQIDFTKLKEEDSLIVIYNSLKALTIKFARLQFCFVDRNNYVLDYGSVLHKIDSLDSISNLKSKSSSTQFSPIWLKNTLYPENIHEHLGIVAVSNSNMEAKKSVLFQDYRCFTSFGRRRPNELKIKVGYLNVDYSDKIDELVEASSWTFVLETLCYSFGLSFDEDDDDDEEDNDDSTDNELDNSSGLLSDAESTTTIHIDSPFDNENATANMVNDRNLLTEGEHSNIENLETVASSVQPALIPNIRFSLHSEEEGTNENENENDMPVLLLSDMDKGIDGITRRSSFSSLIESGNNNCPLHMDYI

SEQ ID NO: 19 - DNA, 3272 bp, Saccharomyces cerevisiae
acagaaatatttgaaatatatttcctcaaagagtacactagatccattcatattttaggcttcctatggaaaccgttttttcaaggataaaccccgccatatgttctttgcgaagtcttttgcagttaaaactaattacaactctgttatttactgacacctgcgttaaaattttatcacaatatgtcatccgctgagagagatgtactatttataattacttaagagcgactacttcatttaccattagcgagcagaagaacagcttacttgtcgatgttcttctctggctaaatgaaatgtcaattattgagattgagatgggtatgtatgatcggattttgatatcagccgatgagacgaagattcaatagcttcaaccgtccctgcggggggtacttaccttttgtaaccagtaccctgtgcaaattctcggcgtgtactacctcttttgggaccacaaccctttgtacgcactttcgtcagatgcaaatttttacacgcgttgaaaaatgtttcaggaagagatactgcgtaaaaaaaagacacatgtgttacgcaggaaaaagtttgtgaggctttttgccttaacagattgacttgtagccctgttaggtttacccaacagttgtttttctgtgtgtcgaaaattttttcagattgttttcaactgacacttgcctgtttcatattagttgtaacttaaactttcaaacataaaacttttttggaagtccatccttcacatgacttgaatcccttcaatatcgaaacagtatcctcaaaatctcttatcacttttctaattgttttcttcccctttttgtagtaactcgctgtaaagcacattttattcataatctcctttgtgccagaactcaaggtcaataggccagaattattggaaggaaagagggaagaaaataagatattgctagttcattaagtcaaggaagaaaatactcaaaaaactgtacagctcaatcaggtacacattacgatggcagcacatcagatggactcgataacgtattctaataatgtcacccaacagtatatacaaccacaaagtctacaggatatctctgcagtggaggatgaaattcaaaataaaatagaggccgccagacaagagagtaaacagcttcatgctcaaataaataaagcaaaacacaagatacaagatgcaagcttattccagatggccaacaaagttacttcgttgaccaaaaataagatcaacttaaagccaaatatagtgttgaaaggccataataataaaatctcagattttcggtggagtcgagattcaaaacgtattttgagtgcaagtcaagatggctttatgcttatatgggacagtgcttcaggtttaaaacagaacgctattccattagattctcaatgggttctttcctgcgctatttcgccatcgagtactttggtagcaagcgcaggattaaacaataactgtaccatttatagagtttcgaaagaaaacagagtagcgcaaaacgttgcgtcaattttcaaaggacatacttgctatatttctgacattgaatttacagataacgcacatatattgacagcaagtggggatatgacatgtgccttgtgggatataccgaaagcaaagagggtgagagaatattctgaccatttaggtgatgttttggcattagctattcctgaagagccaaactcagaaaattcttcgaacacattcgctagctgtggatcagacgggtatacttacatatgggatagcagatctccgtccgctgtacaaagcttttacgttaacgatagtgatattaatgcacttcgttttttcaaagacgggatgtcgattgttgcaggaagtgacaatggtgcgataaatatgtatgatttaaggtcggactgttctattgctactttttctctttttcgaggttatgaagaacgtacccctacccctacttatatggcagctaacatggagtacaataccgcgcaatcgccacaaactttaaaatcaacaagctcaagctatctagacaaccaaggcgttgtttctttagattttagtgcatctggaagattgatgtactcatgctatacagacattggttgtgttgtgtgggatgtattaaaaggagagattgttggaaaattagaaggtcatggtggcagagtcactggtgtgcgctcgagtccagatgggttagctgtatgtacaggttcatgggactcaaccatgaaaatatggtctccaggttatcaatagcttcgaattggaaatactgtgagcagtaattatcaatggatgctattatataaatatacatacctacacccatcccatatttacatagaataacaacagtaacattagttctgtggaagcgcaaaaacgtcctttaataaagtaagtcaaaacattcaacaatgaaaattcaaagcattgtcatttgcttcctttttctctttggataaacgaaacaaaaacgaacaaaagtgtcatgcactcaaaaattcttttcaatcgttttggaaacagtattattcactgacttatttgaccaacttgctagaatcatctatgttttcaggcattgtttaatttcatgatggctgtccctactttagcttgttatgagccttcactggctcgtccttatgtattgcgtctgacccaaaatttgtcctttcttgtttagtggaatttttgttcggtaatttcaaaaatgcctgaattttcattaacaaatcatctggtagttgtgttataaacataaaaaactgctcccttctgggatgattttcaattgctctctgtactgcaggatcattcaatatcatctgaaccacgtccgtcatcatatcctcatctataagcgcaaggcttttaatccagggcaaatcggctatacgaagagacatttcttcctccggagacactactttccacgggagatcaaaatatttagatagttcactattgagatgtgagaattcatgaggcacatcaacggtatagtcaactgcatatgcatcatcttcaaacgttaagtcatgttcaatgctaaactttccagcgttacctataaaaaagcattctatttttaagttaaactctccccaaccggtttccttgataaaaaatggcagcgagttcagtcgtcttttgggctgtttgaagctagagtgcaaatggtagatgcatttagagaggatggtaggctccacttcctttcctgttgcatctaacatgaggagttccatct

SEQ ID NO: 20 - protein, 423 aa, Saccharomyces cerevisiae
MAAHQMDSITYSNNVTQQYIQPQSLQDISAVEDEIQNKIEAARQESKQLHAQINKAKHKIQDASLFQMANKVTSLTKNKINLKPNIVLKGHNNKISDFRWSRDSKRILSASQDGFMLIWDSASGLKQNAIPLDSQWVLSCAISPSSTLVASAGLNNNCTIYRVSKENRVAQNVASIFKGHTCYISDIEFTDNAHILTASGDMTCALWDIPKAKRVREYSDHLGDVLALAIPEEPNSENSSNTFASCGSDGYTYIWDSRSPSAVQSFYVNDSDINALRFFKDGMSIVAGSDNGAINMYDLRSDCSIATFSLFRGYEERTPTPTYMAANMEYNTAQSPQTLKSTSSSYLDNQGVVSLDFSASGRLMYSCYTDIGCVVWDVLKGEIVGKLEGHGGRVTGVRSSPDGLAVCTGSWDSTMKIWSPGYQ

SEQ ID NO: 21 - DNA, 2333 bp, Saccharomyces cerevisiae
atattatatatatatatagggtcgtatatatatcgtgcgtcttcttccttctctaagggtaaaattccttgtatttgttataatagtagtaactgccgagcccacccaaagctgtcaaaacgacagggacaggtttagtgaacctggaaggcatgcctcttatgacaccagcaccaagtagtaaggtcgatgcacccaatgccatttcgagcccaccatctctattcatatgtagcaagtaaccggcaatcccatatacactaccgaatactaagccagatactagagatggaatggagcccttacggtagtatcccataaggccaccggctgtagtcaaaagactcaatgtatatgctggatgttccatagtgtgatctgatgttcctttctctcaaacttcgtttctgtcttgtctcccgctgttacctaataacttcatgtgatctgctcccccttctcgttaaataccaccttttcatcaaccccgtagggcgcgacacgtctaaaatattaacctctgaatacttattgggtcaaaatggatgttaataactttcctttacaaaaaaagggctaatagagtatatgcatttcggtagtgaaatattcgttaatgctaatatgctcagtagtgatcctagattaccagttttactgcagccatcgtacaattttggaacgagtataaagagagaaattaaaaacgacgagaaatattcgtaccagcttctcttccggcttgatgacagtcttaatatcatctgcaactcttgaaatcttgctttatagtcaaaatgtacgtacgcttttcactatataatatgatttgtcaatgtgatgagtgaatgtctctctgttacccggttgtcatgttgatttttgtttcaggctctaaatgtttgatgcaatatttaacaaggagaacagaaatgttttgtgacagcacctgtcaattttaggatagtagcaatcgcaaacgttctcaataattctaagaatgacatcagttcaaaactctccacgcttacaacaacctcaggaacagcaacagcaacagcaacagctttccttaaagataaaacaattgaagttgaaaagaatcaacgaacttaacaataaactgaggaaagaactcagccgtgaaagaattactgcttcaaatgcatgtcttacaataataaactatacctcgaatacaaaagattatacattaccagaactatggggctaccccgtagcaggatcaaatcattttatagagggtttgaaaaatgctcaaaaaaatagccaaatgtcaaactcaaatagtgtttgttgtacgcttatgtaatgatagtaatagaatccaaaaaaaaaaaaaatatacatgctttttcatatcctctctcaccctatctttttttttcttctaattttggctccgttcatatcttattcaaaattaattcagcggtaatcttatctttattgttagacttcgcagaaatttcctttagcttcgatgcagatagtttgatcaagtcattttgtttattacgtcccagttcgcgagaaataatgttaaccaatgcccacccttttaggtatagttcgctaagttcaacgctcctcaaagcattctttaatgccttttccaagagctcgatcttggtttgtttcttgctacgtagagcctcataatacagagtctcacttagcctaccaaaacaagcgtaattgaatggtgtaatacataggacctgttccaaacaataacgggctttttcaaattggcccatttcgaaataaatctcgctggcataccaccacaattctgcatcaagcgggaatttatctgtaagagccaccacttctttaagaatactttcttggctcaaattcttggaagttgtcttaatagctatcaatttctttgcaatagagacataagtaacgaagtccgtttcatactccagatcatcattcaacaaattttccagatattcaatagcgcctttatcatttccgtttatctgcaataaagtggctttcatgattaccattttatacgaattttcaccaagacgatctcttaatgtattataaacaacttgcgcatcaacgtcttggtttcggtacaccaaaacatagaaaagcatttccatcaagaagaaatagtttccttctgttagtgcagagtctccgcttttcatgtaaattttcatttcattttctagttgcagtaattgttctggattaaattgagtatacgctttggtattcataattgtcaagagcttttctctaaccaaatccttcaacattgttttatctactgctttctataattt

SEQ ID NO: 22 - protein, 110 aa, Saccharomyces cerevisiae
MTSVQNSPRLQQPQEQQQQQQQLSLKIKQLKLKRINELNNKLRKELSRERITASNACLTIINYTSNTKDYTLPELWGYPVAGSNHFIEGLKNAQKNSQMSNSNSVCCTLM

SEQ ID NO: 23 - DNA, 4067 bp, Saccharomyces cerevisiae
cctcagatgcgcaattcatggaattgtactcttgccagaagttaagtggttcgatagtcactccattggacgtagaaaactctttattacagaagttgtccgcaaagagtttgaagatatccctaacaaagcggaacaagttccagttccgccatcgagaaatcgtcaagagtatgcaaggagtttatcacaaccatcacaactccgttaatcaagagcaggtcttgaacgttttgttcgagaatagcaagcaagttctttcaggtttaaaagatatgttgaaaagcgacgggcaacccacttacttacatctgaaaattgcaagttacattctttgtataacgaacgttaaggaacccataaagctaaagacatttgttgaaaacgaatgtaaagaattggtccagtttgcacaagacaccctgaagaacttcgttcagtaatcactttcaagctgtagtatgtaaacgatatagatgaagttttcgtgtgtataaatatatgaactctagagtgttgcataatttgaaacacagcatttcttttcggagagctcgtttcaaaatgaaacaaacgccgttgtccgttttcgtctcaatagaaaaagtgaaacagataaaaattgttttaaaagaaacgaatttgcaacatcttaagatatatcaaaactaatacaaaacagcctaaaaaagattgaacaactcttcgcggtcaggtctcgacaccataaatcgaagtactcgtacgctagttttctcgcacatagtaccactacgttccttttacaattagattacttctttttagttgacttttttgagacgttcgtgccattcataaaataggaaaagataacaggtaagcactgaagacttgttttataagtgtcccaagcgagacctagagtggatattgatatttctcaaacaagactcgtcgaagaaaacacacttttatagcggaaccgctttctttatttgaattgtcttgttcaccaaggatgaaagtccaaataaccaatagtagaacagaggaaatcttaaaagttcaagctaataatgaaaacgatgaagtcagtaaagctactccgggcgaagttgaagaatcgctaaggttaatcggcgatctaaaattctttttagccacagcgccggtaaattggcaagaaaaccaaattataaggcgatactatctgaatagtggacaaggctttgtctcttgtgtattttggaacaatctatactatattacaggtactgatattgtcaaatgttgtctttacagaatgcaaaagtttgggagagaagtagttcaaaagaaaaaatttgaagagggtattttttcagatttaagaaatctcaaatgtggtatagatgcaactttagaacaaccaaagtccgaatttttgtcgtttctattcagaaatatgtgtctgaaaacccaaaaaaagcagaaagtatttttttggttcagtgtagcacatgataagttgtttgcggatgcgttggaaagagatttaaaaagagaaagtttgaatcagccttcaacgactaagcccgttaatgagcccgccttatctttttcatatgattcctcatctgataagcctctctacgatcagttacttcaacatttagattctagaagaccatctagtacaacaaaatcagataattcgcctccaaaattagaaagcgagaattttaaggataatgagttggtaacagtaactaatcagccgcttttaggcgttggcctcatggatgacgatgcgccagaatccccctctcaaattaatgattttattcctcagaaattgattatagaacccaatactctcgaattgaatggtctcacagaagaaacgcctcatgacttacccaagaataccgctaagggcagagacgaagaagattttcctctcgactattttcctgtatctgttgaataccctacggaggaaaatgcgtttgatccgttccctccacaggcttttacgccagctgccccttccatgcctatttcctatgataacgtgaatgaaagggattctatgcccgttaattctcttcttaatagatacccctatcagttatcagtggcacccactttcccagtgccaccatcatcatcgaggcaacattttatgacaaatcgggatttttattcatctaacaataacaaggaaaaattggtatctcctagcgaccctaccagctacatgaagtatgacgaaccagttatggattttgatgaatctcggccaaatgaaaactgtacaaatgcaaaatctcacaactctggccagcaaactaaacaacaccaattatattctaacaacttccagcaatcttacccaaacggaatggttccaggatactacccaaaaatgccgtataatcccatggggggggatcctctactcgatcaagccttttatggcgcggacgattttttctttccaccagaaggatgtgataacaatatgctgtatccacaaactgcaacttcatggaatgttttgccccctcaagctatgcaaccagctccaacctatgttgggagaccatacacaccgaattatagatcgacaccaggttccgcgatgttcccatacatgcaaagttcaaattccatgcagtggaacactgctgtttcaccttatagttcgagagcaccatctacaactgctaaaaactatcctcctagcacattttattctcaaaatataaatcaatacccacggcgaagaactgtgggaatgaagtcttcacaaggaaatgttccaacaggtaataaacaatctgtgggcaagtctgcaaaaatttcaaagcctctacatattaagacaagtgcttatcagaagcaatacaaaatcaacttggaaacgaaagccaggccaagtgctggtgacgaagattctgctcatcctgataagaacaaagaaatttcgatgcctactccggattccaatactttggtggtccagtcagaagaaggtggagctcattcacttgaggtagataccaatcgaaggtccgataaaaaccttccagatgcaacctgatataatataatttttgaatttatgatacaagaattaaaaatgcgggccagaatttaatattaaacaatactcagaagaaaacaacaaggacaatctgtttttataaataaaacaatcttatacaagactagagcaaacaaaaagcaagaaaaaaaggtaataaatgtaacaaatctattaacgttagaaaataacaaaaaaaaaaaaagaaaaagataatataatataatacctttatatatgtgatttatctagcgtcacagtatgtaatataaatatcaatgagtttcttaacatgacctccaaaactacatgatcgcttagtattacaatatgtgtttatccactattttgataccaacgtagtattgccttttatttttcagaatggcaaaggccatcggaaaatttttccaccagaaaaagcgagattcctaattataaggtgaaggcatcgatgttcataatagttaaaagttgtaatcaaaaaagaaaaaggtgcagagataaacaaagttaataaatgacaaaatcaagaaagcagaagcaaaaaaagcaggattttttgagaaaaaagttaaaagttggtaagccaaaggaaaaagcaaggaatgctaccgatacatctttcgtttccaagactatttctattagaaatcaacatttagaccaaaatccacatgatttaacaaaacggctaacgctcttaaagcatcataacatcaatgtgagaaaggaaacattaacaacattccaaaagtcaataccgtctataataaaatctcgacttatgacaccattacttactcaaagtataccgttgatttgcgatgaatcgcagcaagtacgtcagggacttattgatctcgtagatgaaataggtagtcacgatgcggagattttaaaattgcactgcaacatttttgtcttatacattaacatggcaatgacacatattgttacacaaattcaagcagattctactaaatttctctctcat

SEQ ID NO: 24 - protein, 688 aa, Saccharomyces cerevisiae
MKVQITNSRTEEILKVQANNENDEVSKATPGEVEESLRLIGDLKFFLATAPVNWQENQIIRRYYLNSGQGFVSCVFWNNLYYITGTDIVKCCLYRMQKFGREVVQKKKFEEGIFSDLRNLKCGIDATLEQPKSEFLSFLFRNMCLKTQKKQKVFFWFSVAHDKLFADALERDLKRESLNQPSTTKPVNEPALSFSYDSSSDKPLYDQLLQHLDSRRPSSTTKSDNSPPKLESENFKDNELVTVTNQPLLGVGLMDDDAPESPSQINDFIPQKLIIEPNTLELNGLTEETPHDLPKNTAKGRDEEDFPLDYFPVSVEYPTEENAFDPFPPQAFTPAAPSMPISYDNVNERDSMPVNSLLNRYPYQLSVAPTFPVPPSSSRQHFMTNRDFYSSNNNKEKLVSPSDPTSYMKYDEPVMDFDESRPNENCTNAKSHNSGQQTKQHQLYSNNFQQSYPNGMVPGYYPKMPYNPMGGDPLLDQAFYGADDFFFPPEGCDNNMLYPQTATSWNVLPPQAMQPAPTYVGRPYTPNYRSTPGSAMFPYMQSSNSMQWNTAVSPYSSRAPSTTAKNYPPSTFYSQNINQYPRRRTVGMKSSQGNVPTGNKQSVGKSAKISKPLHIKTSAYQKQYKINLETKARPSAGDEDSAHPDKNKEISMPTPDSNTLVVQSEEGGAHSLEVDTNRRSDKNLPDAT

SEQ ID NO: 25 - DNA, 3548 bp, Saccharomyces cerevisiae
accagtggtcaccatacatgaaataccacagtgttttcccaatgtacggacgacttgggaagtttgcagagctaactctcttgtgggaaccatgatcaaagcctgaattttattcaactttggtttgactttctctaacgtaggaataacaaatgcggctgtcttacctgtaccattctttgctctggccaatatgtctctaccagttattgctaccggaatagcctcttcttgaataggggatggtttttcaaaaccggcttcaaaaatacccattaacagctctcttttcaaataaaaatcttcaaaagtattaccctttgtatttaagacatcatctgtctgtggtctggtatccttcttgggaatattcaatgcagttttccagtcccgatcgagatccgtattactgttattattagtgttgaagttattattgatggaacccattactactattttctttcttgtcgtattttaggcctgggataagttattatgcgaatggcgatgcggttatgaagaaataaaagggctaaaagtaagaattttctgcgtctatctttctattaggaataaaatatgactatatttactattattgttgttttgtcgtacaatcctttatgaatgaaaatattaagcttgtggtcttaaaagaatgtggatgaaacaaaactgaatccaatgatgagaaataaatgtacaatcagataataaacacttttattgatgattgtcttttcttgcaaaccccaatgttacaatcgcccattagttctaagattgtgttgtcctttttcttacgaaatttttttccctcccttttttgatcactgtcctcgttataagtgattcgtggggtaacggcgatatcatactattattggcccatctgatggattagaagacctacaggttaatgtgaagcgacactaatgataagaaaactgcatcggatcatatctgtttttgcagcgtggtatattggttgttggtcatgtttcaacgaaagactttacagagaaggaacttgaaagggctcaatcttaacctgcacccagatgtgggcaataatggccaattgcaggaaaagacagagactcaccagggacaatctcgaatagaaggccacgtgatgtctaacattaatgcaatacagaataatagcaacctgtttttgcgaagaggcataaaaaaaaaactgacgttggatgcgtttggtgatgaccaagctatatcgaaaccaaacactgtggtaatacagcaaccgcaaaatgaacctgttttagttctgtcttctctatcacaatccccgtgtgtatcatcatcatcatctttgtccacgccatgcattatagatgcgtacagtaataatttcggattatcgccatcatccacgaattctactccctctacgattcagggattgtccaatattgcaacaccagttgaaaacgaacattcgatatcactaccacctttggaggaaagcctatcgccagccgcagcagatctgaaagatacgttgtcgggaacttcaaatggtaattatatacaactccaggacttggttcagttggggaaaattggtgctggaaattctggaactgtggtgaaggcactacatgttcctgattccaaaatagttgccaaaaaaaccattcctgtggaacagaataacagtacaatcatcaaccaattagttagggaattatctatcgtcaaaaacgttaagccccatgaaaacattatcaccttctatggagcttattataaccagcatataaataatgaaatcataattttaatggaatactctgattgtggttctttagataaaatactgtccgtttataaaaggtttgttcaaagagggactgtttcgagtaagaaaacctggttcaacgaattaacaatatcaaaaatagcgtatggcgtactaaatggcttggatcatttgtaccgacaatataagatcattcatcgtgatatcaagccttccaatgttctgattaatagtaaggggcagattaagttatgtgattttggagtttccaaaaaactaataaattctatcgctgatacatttgttggaacgtccacttatatgtcaccagagaggatacaaggaaacgtttattctatcaaaggggacgtttggtcattgggcttaatgatcatcgagctggtaactggagagtttcccctaggtgggcataacgatacacctgatggcatattggatttgctgcaacgtattgtcaacgagccttcaccaagattacccaaagaccgtatctattccaaggaaatgacagattttgtcaataggtgttgtattaagaatgaaagggaaaggtcatcgattcatgaattgctacatcatgatcttataatgaaatacgtatcaccgtctaaagatgataaatttagacattggtgtagaaaaataaaatctaaaataaaggaagacaagagaattaaaagagaagccttggaccgtgccaagttagaaaagaaacaatcggaaagatcaacccattgaatgcatgcgataacattagttaggaacatattgcactttttttcacatccctttctcaaagctatattcatatatatatagactctcctgattatgtaaatcacaaaccaattttctaatgtaacaatatttttaaaaataatcatcaaagtagcactttatgtacagaaaatttcacgattgagagaagcttgcgaataatactagttagcctgtgtttcaccatcgttacttaatttcttagagttcttatattctttatttttatgccacaaccaaccttcggttcctctaacgaaaccgaaggcgattaataacccaccgaagctacgtaaagttactttccaccattgtgggtttcttttttcaaattcagtcagagaaatgcctcttttggcttcttttttaccatacttgaatggtttcccagatgccaagtatgagccaaatccaacagaaaacatagtgctcatgacttgacaaggaacgcaatccatagtctcttctttttccagctccctttgtggtggagggttgaacactgccaaaatattactcattgtttttcaccacttgctgtttctctctaagcggtgttttgtttcctacttggtggcacacaatgactgtactcgctttatatgctcgtaccttttttcaaaagcccatcgttaatttttcacccgaggaccccatattacgcgttttttgttaatgttcaatttctgacatgttacaattataataacgccaaaagaggtaaatgtatatttgaacaattgttaaagagaagataaaaaccttttaatcttgcatttgtcgtcaatagtacacaataggcgatctattttagtacggtaattaaaagaaagctgcctttcagtcaagaatgccggaattaacagaatttcagaaaaaacgtttagagaacatcaaaaggaataacgatttattgaaaaaactccacctttctggagtagcatctcaaattaagcacgag

SEQ ID NO: 26 - protein, 515 aa, Saccharomyces cerevisiae
MFQRKTLQRRNLKGLNLNLHPDVGNNGQLQEKTETHQGQSRIEGHVMSNINAIQNNSNLFLRRGIKKKLTLDAFGDDQAISKPNTVVIQQPQNEPVLVLSSLSQSPCVSSSSSLSTPCIIDAYSNNFGLSPSSTNSTPSTIQGLSNIATPVENEHSISLPPLEESLSPAAADLKDTLSGTSNGNYIQLQDLVQLGKIGAGNSGTVVKALHVPDSKIVAKKTIPVEQNNSTIINQLVRELSIVKNVKPHENIITFYGAYYNQHINNEIIILMEYSDCGSLDKILSVYKRFVQRGTVSSKKTWFNELTISKIAYGVLNGLDHLYRQYKIIHRDIKPSNVLINSKGQIKLCDFGVSKKLINSIADTFVGTSTYMSPERIQGNVYSIKGDVWSLGLMIIELVTGEFPLGGHNDTPDGILDLLQRIVNEPSPRLPKDRIYSKEMTDFVNRCCIKNERERSSIHELLHHDLIMKYVSPSKDDKFRHWCRKIKSKIKEDKRIKREALDRAKLEKKQSERSTH

SEQ ID NO: 27 - DNA, 4154 bp, Saccharomyces cerevisiae
taaaacatccttcataaaaacgaccaatatgaaaacattcgtcatagcctatatttacaactagcttatcgtcatttgagaatccctctagacctttattttggaaccatagattatcaacgtgtgatatcgggagtgcaaggtcgaaaccaatgtgctcttcaactcttggcgcctgtaggaagtaaaatagggcaatcactacaaaaactaccaagtataataggtacctttgatacagcctcggtaaccggatcatgttaagatttttaaccacggtgctggtcttcgatacttaagtataaaacttgtatcagaggtatctgcgatctaaaaagattaatttttgaaaaagatcaacactaaaccatttgaaattcaaaaagcacctaaggcaaaatataaatctaaatatacgtaaaatggaaacactttctgcgcagctttatacaagttagccttctagcttatgaaatagaaatgaaatataactgagcaagtcctatatacaatactattaatgatcttcttgtccatgagactgttcatggtgccttttagagacttcttcatcacttatctgaggcctgtggccacccgttctcaataaaccaccggcagtatcttcaactggaaatcttgcactgggtcttacgcaatggggcttgcgtaactgttcaaaatccatgattttagttttccctcccccttttaaagtaatctttggattctcgcccaacttttcctccacttcttttatattttgggtgcgttctttactattactattattattattattactaactgccattatagtttctttatgctgtcctcaccatgcctttcgttatcaggctagcattaaaagccttttaaggtgtaaagctttcgccgcgatggctttaaacagtagaaaatattcatatttacacacatgcataaagagagaccacttaataaagctagtatgataagatcaccggtagacgaaatatacatggaacagacacaaacagcagagggcactgacttactaattggtgacgaaaagaccaacgatttaccttttgtgcagttatttctggaggaaataggatgcactcaatacctggatagctttattcagtgcaaccttgtcacagaagaagaaattaagtatctcgacaaggatatcctcattgctttgggtgtaaacaaaataggagacagactcaaaattttaaggaagtcaaaatcgttccagagagataaacggattgaacaggtgaatagattgaaaaacctgatggaaaaagtaagctctctatccactgctacgctatcgatgaattcagaattgattcctgaaaagcactgtgttatatttatcttaaacgatggttccgctaagaaagttaatgtaaatggttgctttaatgcagattctattaagaaaaggctaatcagaagattgccacatgaattattagccacaaactccaatggagaagtaactaaaatggtccaagattatgatgtgtttgtcttagattataccaagaacgtactgcatttgctatatgacgtggaattagtcactatttgccacgcaaatgatcgtgttgagaaaaataggctaatttttgtttccaaagaccaaacaccaagtgataaagctatatccacatccaaaaaactatatctaagaacgttgagtgcattgagccaggttgggccatcctcgtcaaatttgttggcacagaacaaggggatttcgcataacaatgctgaagggaaactccggatcgacaacacagaaaaggacagaattagacagatttttaatcagaggcctcctagcgaatttatttctaccaatttggccggatattttcctcatacagacatgaagcggttgcaaaagacgatgagagagtcatttcgccattcagcaaggctaagcattgctcaaagaagacctttaagtgcagaatcaaataatatcggtgacatactattgaaacactcaaacgctgttgatatggccctattacaaggattagatcagacaagattaagcagtaaacttgacacaactaaaattccgaagcttgcccataaaaggccagaagataatgatgccatatctaaccagttagaactattaagtgtagagtctggtgaagaagaagatcacgatttctttggggaggacagtgacattgtttcattaccgacgaaaattgccacgcccaagaattggttaaaaggtgcttgcattggatcaggcagttttgggagtgtttacttgggcatgaatgctcacactggtgaactaatggcagtaaagcaagtggagataaaaaataataacattggtgttcccacagacaacaataaacaagccaattctgatgagaataatgagcaggaggaacaacaagagaaaatagaagatgttggggcggtaagtcatccaaaaaccaatcaaaatattcacagaaagatggttgatgctttacagcatgaaatgaatttattgaaggagttacatcatgagaacattgttacttattatggtgcttctcaagaaggcggaaatttaaatatttttcttgaatacgttcctgggggttcggtttcctccatgctgaataattacggtccatttgaggaatcactgattactaatttcactaggcaaatactgattggggttgcgtatttgcataagaagaacattattcacagagatatcaagggtgcaaatattttgattgatatcaaaggttgcgtaaaaattactgattttggtatttcaaaaaaattatcacctttgaataaaaaacaaaataagagagcttctttgcaaggttccgtattctggatgtcaccagaggtggtcaaacagaccgctactactgctaaagcggatatatggtctacaggatgtgttgtcattgaaatgtttaccggtaagcatcctttcccagatttttctcaaatgcaagcgatcttcaaaataggcacaaacacgacccccgagataccttcctgggctacgtcagaaggaaagaatttcttaagaaaggcatttgagttggattatcaatacaggcctagtgcccttgaattgctgcagcatccatggctggatgcacacataatttgaaaaagggctacttattaattctttttatggcactaaagtgctctggccgattttttatcaaataatacatatatatcatatttagtgacatttattgaatatatctgctatttaccggtttttttttttcaattacgctgattaagtaatcataaatcacaattgtgaaaaaaagaccaaactagatgacggtatttgattctcatacccctggaataaaatcaagtaagataattctgataaaaaaatccgaccgcacagatggaagcacgaagaaacaggcctttctttgcgaggtgatatcaaaccattgatatcttctcaataacctgctctaggaaaaggaggtagatagacaaaagcaaggaaataatccatagagtttcattcacatgaataatctgttaccaatttttctcataagataaagccatctatcaaaaatgatattgaaatatttgaaaaatgcttgtttttatggggaccacaattcgcctgtacctctagaagcgtaaactgttttattgaagttagtcctgataatttctctaccgttttcgctttcttccttagtgccattttttagcatcatattattgaatttttcactttctctaaatgatttatcattcatgtccttggacaagattgaatctacatcaacaattgaacaggaaggaatattgcattgcatggccatttcccggatttgaggatcttcactaattaaaaaccaatgtagcccctcatttccttctaggtagcatttgtaaatacaacttttcaacaaattctttaatctcttaggcaattttgcaatattaatctttccagaactatcattatgttccattacatctgaccataaaataatgtctaaaacttcgggaaattcgataaaaactttcaaattagcaaatttagaatcatctaatctatcgataaacttcaaggattctcgagctgcaaaacttttacgcctttgttgaaggaaatccaa

SEQ ID NO: 28 - protein, 717 aa, Saccharomyces cerevisiae
MEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 29 - DNA, 3083 bp, Saccharomyces cerevisiae
tgcactcaaaaaccttcttagttacaggaaaaggtaaagatacgataagaaaagcctttgaactgcccatcctgcatcctaacacagatctaactcactattcgggtaaggaagtgtcatgcatgtctgcaaagggactagaagaaagttacatgattacataagcaaaaaatcggaattacagacacaccattttttatcctgcggccccatttccgtcttcgagggaaaggatcaaaggcgcttagcccaatcttgatgattcaccggggaagaaaggaattacagaacccccagccacgtaacacagccaattagttttctatatcgggaaacgtgattgattgcgcaattttggctgcatcagaatacatcgatgagatctagagcaccctttgatggtttaagtccggtttaaagttagtagatcaatgatttcgtagtgcattttaaagggagcgcttatccatgggtgattgcgtttacaacgttttgtgtgtactcataatagccaatctaaaattaaacaacaacaacaacgcacaattaatatgtatcagccccaatacctttttctcttactgtaatttactactaaattggggtcggacgtttttgatcttgttccttgcctgttgtttaccttgtatattacttttcctcttttatgtatttaaggtaaattaattatcttttgatcttaatatttttctcaaaatgcttcccttgtagttcggtatttttgcttcttcagatatttaaactaccgtataccataactgtttcgtgaagtagatacaaacatcgactatcctattacgatttattttacattatcatattataaatcgaccagtagtattgttaaagattaaaagcataatatactactgtcattagtcacctacagagaaacaaattcctactggcacccattactggtgaaaaaggaaaaaaataataaaagaaaagcttttctattcctctccccacaaacaaaatgcaagcggatatgcatggaaaacttcacgctgccttagaagatggtttcttcctctttccttttgaacagcaacaacaacctaacatttattatgacacaaccaccgatcaagaagaccgtccttgtttttcttttggatctacaatttcccctagaagttggcattttgaaaagtctgacaaaattgcctcatctcagctgcagaacttggttcatacacaaccaattcatttaattaatcctcaaatattgttcaatgaagagtttctgaatttggaaaatattgattctcagcctatttccaaggaaacgaaaactacgaaggactgcacaatggcaactggtcctgaaagaggaaaaaagagctctgaaagtaccagatcctcttcattatcatctcttttttctaatgatgaatccgcatctacgttccactcatcattcaataaccatgataactttcaaaagagcaacagaaatggagatgatatcgatattagtgacacaataaaatatgaaactaatacaaatgcacaaaaagatatcaaaatattccaagaaaattttgaattcaatgaattcccatacacacaagacttctacccatataccactaattatacctattcaaaacccacaaatattcatgaatcaataaattcaaaaaacacggattcatactcccaatatcaagatcagtttccaccacatactgataacatacattcctttaataatcgtcactatagcaaccataaaagcactaattgtaattactataataataccagcaataataacaacgcctccgataatgtatatgaggcagatccatttatagatgaacctcaggtgccctcctactattacccattagaaattgccttcgacgttgaaaaatcaccaccgccatcactacaaaaattaaattcaaaagagttagaattcctaaaaaagttgaactccaaactgtcaagatatgctgcggcttactccttcagcagttctaatgatcaagattattatgacaaggtcaggtttcaagaaatatcctacaagtttagtaaaacctattcttaattctcgaaaagtactacaatcttcccccttccctcaaaatatatccattcacactcatttctttatttccattgtctcactcaaattgctaagaatttgtgtatttgcatatatatatgtattcaatgtctcaagctccatgacataataccgtagcgttattagccttatcgtatgtcgcgatgggaaaggagattcgttttaatcttgaaaaaccttcgtagcgaataatgcgacataaatcttgagagagtacatcaccaaattcactttgttaaaccgcaccatcgtgctttgcattcttattccttttgcctacactaaaattattagcatttctctaaatgagctccagtgaagacgaagacgacaagttcttgtatggttccgactccgaattagcactaccttcttctaaacgatcaagagatgatgaagcagacgcaggtgcgtccagtaatcctgatatagttaaaaggcaaaaattcgactctcccgtggaagaaactccagctactgccagagatgatcgttctgatgaagatatctactctgactcctcagatgacgatagtgattctgacctagaggttatcataagtctgggtcctgaccctactaggttagatgcaaaactactcgattcttattctaccgcagcgacatcttcaagcaaagacgtaattagcgtagctacagatgtatccaataccatcacaaagacatcagatgaaagactaataacagaaggagaagcaaatcaaggtgtaacggcaacgaccgtaaaagctacagagagcgatggaaatgtaccgaaagcaatgactggttctatagacctggataaagagggaatctttgatagtgttggcataacgacaatagatcctgaagtattaaaggagaaaccctggaggcaaccgggggccaacttaagtgattatttcaattacggttttaacgaatttacctggatggagtatttacatagacaggaaaa

SEQ ID NO: 30 - protein, 360 aa, Saccharomyces cerevisiae; identical to SEQ ID NO: 2

SEQ ID NO: 31 - DNA, 3938 bp, Saccharomyces cerevisiae; identical to SEQ ID NO: 3

SEQ ID NO: 32 - protein, 645 aa, Saccharomyces cerevisiae; identical to SEQ ID NO: 4

SEQ ID NO: 33 - DNA, 3884 bp, Saccharomyces cerevisiae; identical to SEQ ID NO: 5

SEQ ID NO: 34 - protein, 627 aa, Saccharomyces cerevisiae; identical to SEQ ID NO: 6

SEQ ID NO: 35 - DNA, 3197 bp, Saccharomyces cerevisiae; identical to SEQ ID NO: 7

SEQ ID NO: 36 - protein, 398 aa, Saccharomyces cerevisiae; identical to SEQ ID NO: 8

SEQ ID NO: 37 - DNA, 3194 bp, Saccharomyces cerevisiae; identical to SEQ ID NO: 9

SEQ ID NO: 38 - protein, 397 aa, Saccharomyces cerevisiae; identical to SEQ ID NO: 10

SEQ ID NO: 39 - DNA, 3875 bp, Saccharomyces cerevisiae; identical to SEQ ID NO: 11

SEQ ID NO: 40 - protein, 593 aa, Saccharomyces cerevisiae; identical to SEQ ID NO: 12

SEQ ID NO: 41 - DNA, 2727 bp, Saccharomyces cerevisiae; identical to SEQ ID NO: 13

SEQ ID NO: 42 - protein, 218 aa, Saccharomyces cerevisiae; identical to SEQ ID NO: 14

SEQ ID NO: 43 - DNA, 3830 bp, Saccharomyces cerevisiae; identical to SEQ ID NO: 15

SEQ ID NO: 44 - protein, 609 aa, Saccharomyces cerevisiae; identical to SEQ ID NO: 16

SEQ ID NO: 45 - DNA, 4754 bp, Saccharomyces cerevisiae
atttcaaagcagtttgtgcaatttgtccagcagttctgtatttgttcaagaccgattcctgtagaatatttttgtcctttagcaaaatctgagtatcctcgtgggagatagctagagccatgatagttttagcaatattagtcgggtcgggttttttcttaaaagtattttgaataacacgatgctttagctcatctcatctcttctgctgaaatttttctttacttcggtaaaattttttcagaaagaaaaaaaagcttcagaggcatgaccctctccgggtaaaaaaagcttagggttaccggcctgtcatttttagggcataataaatttttgccatctagttgcaactataataatacagtatgaattgcacgaaagagcagtcaatgtaaattcacgaagtgactgacagaatactgacatcagctgatttctcatggagctgtttctctgataacacgttgtttgaacatcgacaagatgaaaatctagaagtatcaagtttcctttaaagggatatataacagattctaaaactgacagaaatatttcgagtgaagaagaagcgttaaatattggatctttccgcagttctactctgatacatttttgaagtaggagagtcatttagaaggcgtattgctcaatagtagaaagcaggcctgtgcacatgaattaattaaaaaatataaaggtagtgattagacgacacatgtccataggtaacctgtcataattttgaacaatttccctttttttctttttttttttttgggtgcggcgatatgtagcttgttaatttacacatcatgtacttttctgcatcaaaatatgaaaggcgatagtagctaaagaaaataccgagaatttcctcgaaaagttgacgacaaaagaaaggcataaaaaagtaatttgaaaatattttaaaactgttttaacccatctagcatccgcgctaaaaaaggaagatacaggatacagcggaaacaacttttaaatgatggaaactcctacagacaatatagtttccccttttcacaattttggtagctcgacacaatatagtggtaccttgtcgagaacgcccaaccaaataatagagctagagaagcccagcactctatctccattgtcaagaggaaaaaaatggacggaaaagttagccaggttccaaagaagtagtgctaaaaagaaaagattctcaccttctcctatttcctcctctacattttcgttctcacccaaatctagggtcacttcttcaaactcttctggcaatgaagacggtaatctaatgaatacaccttctacggtttccactgattatttaccacaacaccctcacagaacatcgtctttgccaagacctaattccaatctctttcacgcaagtaatagtaacctatcccgagcaaatgagcctccaagggccgaaaatttatcagataatataccacccaaggtcgctccatttggctatccaatacaaagaacctctattaaaaaatcctttttgaatgcttcttgtacgttatgtgacgagcctatttctaacagaagaaagggagagaaaattatagagcttgcatgtggccacttaagtcaccaagaatgtcttattatctcttttggcaccacttcaaaggcagacgttcgtgcgctatttcctttttgtaccaaatgtaaaaaagatactaacaaagccgttcaatgcattccagaaaatgatgaactaaaggatattctaatttctgattttttgattcataagattcctgattctgagttatcaatcacacctcagtcccgctttcctccttattcaccactcttgcctccttttggtttatcctatacacctgttgaaagacaaacgatatattctcaagctccaagtctaaacccaaatctcatattggctgcaccccccaaggaaagaaaccaaattccacaaaaaaaatcaaactatacatttttacattcacccctggggcacagaagaattccgtccggagcaaactctatcttagcagacacctctgtagcgttatcagctaatgattctatttctgctgtttccaattcggtaagagcaaaggatgacgaaaccaaaataacgttgccgctgttaaggtcatattttattcaaattcttttgaacaatttccaggaagaattgcaggattggagaatagacggggactatggattactaaggttggtagacaaattgatgatttccaaagatggtcagagatatatacaatgctggtgtttcttatttgaagacgcatttgtaatagcagaagtggataacgatgttgatgttttggaaactagactaaagaatttagaagtatttacacctattgccaacttgagaatgactacactcgaagcttcagtactcaaatgcaccttaaataaacaacattgcgccgatttatcagatctttacattgttcagaatataaattctgacgaaagcacaactgtacagaaatggatatctggtatattgaatcaggattttgtattcaatgaggacaatatcacttccaccctgcctattcttcccattataaagaacttttcaaaagatgttggtaatggtaggtacgagacgagtacctttctaggtttaatcaatcctaacaaagttgttgaagttgcaaatgtgcacgataatgatactgtaatcataaggaggggattcaccttaaattcaggagaatgttctaggcagagtactgttgacagtatacaatctgttctaactacgataagctcaattctttccttaaaacgagaaaaacctgataatttggcaataatcttacagattgactttacgaaattgaaggaagaagacagtttaattgttatttataacagcctaaaagctttaaccattaaatttgcgcgtttgcagttttgtttcgttgatcgaaataattatgttctggactatggatcggtattacacaagatagattcactagattccatctcaaatctcaaatcaaagagttcctcgacacaattttcacctatttggctgaaaaatactctatatcccgaaaatattcatgaacatttgggtattgttgctgtatcaaatagtaatatggaagcaaaaaaatccgtactatttcaagattacagatgctttacaagttttggaagaagaaggcccaatgaattgaagattaaggtgggctatttgaacgttgactacagtgataaaattgatgaactagtcgaggccagctcctggacttttgttttagaaactctttgctacagtttcggtctaagttttgatgaagatgatgacgatgacgaagaggataatgatgattcgaccgataatgaacttgataatagttcaggattactgtcggatgctgaatctacaaccactattcatattgactctccatttgataatgaaaatgctaccgcaaatatggtgaatgacagaaaccttctcactgagggtgaacatagcaatatagaaaacttagaaactgtcgcttcttcagtacagccagctctgattcctaatattagattttcacttcattctgaggaggagggtactaatgaaaatgaaaatgaaaatgatatgccagtattattacttagtgatatggataaaggaatcgatggcataaccagacgcagttcattctcgagtcttatagagagcggtaataacaactgtcccctccatatggattatatatagagtatacactaaattttatgcaataataaaaaggaagcatcccgccaaacgtttcttaactatatattgttacatagcttgattccgtgaatttgaagtggacgcagttcttcttagtctttcaagttcatagtaaatagacattacccaaagatctctttcctgtcttgatcttgccatgaaaaccattgacttgccgctcacacctaactttttagtgaaatggatcttatctgtgttacttggaacattagtgttattcaagtcagcttccggagcagaaggtgggtcaatattattatcttgtctaccataatcttgcgtatattgcttttcattccctttcttctgtaagcgattgctagaaagggcacgccttgttccaaaccaaagcgtaaagcatcgcgaactctcgtcttctacagatcgccatccgtccccataaactcgtgggagagcgtgggatccatagtttatttcgtcaaaagtacgatctctctgcagaaggtctagttctgttgtggtcccagagtataggtagcaatcgtcaatcggaatggttacataatgagcatactccaaaacttccttagcaaaacctgtggttgatctatgaaagcagtggaacagtacaataaaacctgatatcaaaacgacgtagtacttcgagaaaacagaatgcttgtgcggcttttgatataaaggtcccttttgaattaacggcctacttaatgatattccatttgcattaaaggtttgctcatctgcacgcccatgttctacgatccagcgcaatgtattctcaccaatttttgtttcctcttctccatttagcatcaaaagacctgcatttgaacgccttatttttaaaagcctctccgtatcttccctttgcttgtttttccaataggatatcatttgtttcagctttatgacccactcttcagcaactgttgctgatgtagcaagcagcttcaagaggagtccatttgaggtttct

SEQ ID NO: 46 - protein, 917 aa, Saccharomyces cerevisiae; identical to SEQ ID NO: 18

SEQ ID NO: 47 - DNA, 3272 bp, Saccharomyces cerevisiae
gacagaaatatttgaaatatatttcctcaaagagtacactagatccattcatattttaggcttcctatggaaaccgttttttcaaggataaaccccgccatatgttctttgcgaagtcttttgcagttaaaactaattacaactctgttatttactgacacctgcgttaaaattttatcacaatatgtcatccgctgagagagatgtactatttataattacttaagagcgactacttcatttaccattagcgagcagaagaacagcttacttgtcgatgttcttctctggctaaatgaaatgtcaattattgagattgagatgggtatgtatgatcggattttgatatcagccgatgagacgaagattcaatagcttcaaccgtccctgcggggggtacttaccttttgtaaccagtaccctgtgcaaattctcggcgtgtactacctcttttgggaccacaaccctttgtacgcactttcgtcagatgcaaatttttacacgcgttgaaaaatgtttcaggaagagatactgcgtaaaaaaagacacatgtgttacgcaggaaaaagtttgtgaggctttttgccttaacagattgacttgtagccctgttaggtttacccaacagttgtttttctgtgtgtcgaaaattttttcagattgttttcaactgacacttgcctgtttcatattagttgtaacttaaactttcaaacataaaacttttttggaagtccatccttcacatgacttgaatcccttcaatatcgaaacagtatcctcaaaatctcttatcacttttctaattgttttcttcccctttttgtagtaactcgctgtaaagcacattttattcataatctcctttgtgccagaactcaaggtcaataggccagaattattggaaggaaagagggaagaaaataagatattgctagttcattaagtcaaggaagaaaatactcaaaaaactgtacagctcaatcaggtacacattacgatggcagcacatcagatggactcgataacgtattctaataatgtcacccaacagtatatacaaccacaaagtctacaggatatctctgcagtggaggatgaaattcaaaataaaatagaggccgccagacaagagagtaaacagcttcatgctcaaataaataaagcaaaacacaagatacaagatgcaagcttattccagatggccaacaaagttacttcgttgaccaaaaataagatcaacttaaagccaaatatagtgttgaaaggccataataataaaatctcagattttcggtggagtcgagattcaaaacgtattttgagtgcaagtcaagatggctttatgcttatatgggacagtgcttcaggtttaaaacagaacgctattccattagattctcaatgggttctttcctgcgctatttcgccatcgagtactttggtagcaagcgcaggattaaacaataactgtaccatttatagagtttcgaaagaaaacagagtagcgcaaaacgttgcgtcaattttcaaaggacatacttgctatatttctgacattgaatttacagataacgcacatatattgacagcaagtggggatatgacatgtgccttgtgggatataccgaaagcaaagagggtgagagaatattctgaccatttaggtgatgttttggcattagctattcctgaagagccaaactcagaaaattcttcgaacacattcgctagctgtggatcagacgggtatacttacatatgggatagcagatctccgtccgctgtacaaagcttttacgttaacgatagtgatattaatgcacttcgttttttcaaagacgggatgtcgattgttgcaggaagtgacaatggtgcgataaatatgtatgatttaaggtcggactgttctattgctactttttctctttttcgaggttatgaagaacgtacccctacccctacttatatggcagctaacatggagtacaataccgcgcaatcgccacaaactttaaaatcaacaagctcaagctatctagacaaccaaggcgttgtttctttagattttagtgcatctggaagattgatgtactcatgctatacagacattggttgtgttgtgtgggatgtattaaaaggagagattgttggaaaattagaaggtcatggtggcagagtcactggtgtgcgctcgagtccagatgggttagctgtatgtacaggttcatgggactcaaccatgaaaatatggtctccaggttatcaatagcttcgaattggaaatactgtgagcagtaattatcaatggatgctattatataaatatacatacctacacccatcccatatttacatagaataacaacagtaacattagttctgtggaagcgcaaaaacgtcctttaataaagtaagtcaaaacattcaacaatgaaaattcaaagcattgtcatttgcttcctttttctctttggataaacgaaacaaaaacgaacaaaagtgtcatgcactcaaaaattcttttcaatcgttttggaaacagtattattcactgacttatttgaccaacttgctagaatcatctatgttttcaggcattgtttaatttcatgatggctgtccctactttagcttgttatgagccttcactggctcgtccttatgtattgcgtctgacccaaaatttgtcctttcttgtttagtggaatttttgttcggtaatttcaaaaatgcctgaattttcattaacaaatcatctggtagttgtgttataaacataaaaaactgctcccttctgggatgattttcaattgctctctgtactgcaggatcattcaatatcatctgaaccacgtccgtcatcatatcctcatctataagcgcaaggcttttaatccagggcaaatcggctatacgaagagacatttcttcctccggagacactactttccacgggagatcaaaatatttagatagttcactattgagatgtgagaattcatgaggcacatcaacggtatagtcaactgcatatgcatcatcttcaaacgttaagtcatgttcaatgctaaactttccagcgttacctataaaaaagcattctatttttaagttaaactctccccaaccggtttccttgataaaaaatggcagcgagttcagtcgtcttttgggctgtttgaagctagagtgcaaatggtagatgcatttagagaggatggtaggctccacttcctttcctgttgcatctaacatgaggagttccatct

SEQ ID NO: 48 - protein, 423 aa, Saccharomyces cerevisiae; identical to SEQ ID NO: 20

SEQ ID NO: 49 - DNA, 2333 bp, Saccharomyces cerevisiae; identical to SEQ ID NO: 21

SEQ ID NO: 50 - protein, 110 aa, Saccharomyces cerevisiae; identical to SEQ ID NO: 22

SEQ ID NO: 51 - DNA, 4067 bp, Saccharomyces cerevisiae; identical to SEQ ID NO: 23

SEQ ID NO: 52 - protein, 688 aa, Saccharomyces cerevisiae; identical to SEQ ID NO: 24

SEQ ID NO: 53 - DNA, 3548 bp, Saccharomyces cerevisiae; identical to SEQ ID NO: 25

SEQ ID NO: 54 - protein, 515 aa, Saccharomyces cerevisiae; identical to SEQ ID NO: 26

SEQ ID NO: 55 - DNA, 4154 bp, Saccharomyces cerevisiae; identical to SEQ ID NO: 27

SEQ ID NO: 56 - protein, 717 aa, Saccharomyces cerevisiae; identical to SEQ ID NO: 28

SEQ ID NO: 57 - DNA, 3083 bp, Saccharomyces cerevisiae
tgcactcaaaaaccttcttagttacaggaaaaggtaaagatacgataagaaaagcctttgaactgcctatcctgcatcctaacacagatctaactcactattcgggtaaggaagtgtcatgcatgtctgcaaagggactagaagaaagttacatgattacataagcaaaaaatcggaattacagacacaccattttttatcctgcggccccatttccgtcttcgaggggaaggatcaaaggcgcttagcccaatcttgatgattcaccggggaagaaaggaattacagaacccccagccacgtaacacagccaattagttttctatatcgggaaacgtgattgattgcgcaattttggctgcatcagaatacatcgatgagatctagagcaccctttgatggtttaagtccggtttaaagttagtagatcaatgatttcgtagtgcattttaaagggagcgcttatccatgggtgattgcgtttacaacgttttgtgtgtactcataatagccaatctaaaattaaacaacaacaacaacgcacaattaatatgtatcagccccaatacctttttctcttactgtaatttactactaaattggggtcggacgtttttgatcttgttccttgcctgttgtttaccttgtatattacttttcctcttttatgtatttaaggtaaattaattatcttttgatcttaatatttttctcaaaatgcttcccttgtagttcggtatttttgcttcttcagatatttaaactaccgtataccataactgtttcgtgaagtagatacaaacatcgactatcctattacgatttattttacattatcatattataaatcgaccagtagtattgttaaagattaaaagcataatatactactgtcattagtcacctacagagaaacaaattcctactggcacccattactggtgaaaaaggaaaaaaataataaaagaaaagcttttctattcctctccccacaaacaaaatgcaagcggatatgcatggaaaacttcacgctgccttagaagatggtttcttcctctttccttttgaacagcaacaacaacctaacatttattatgacacaaccaccgatcaagaagaccgtccttgtttttcttttggatctacaatttcccctagaagttggcattttgaaaagtctgacaaaattgcctcatctcagctgcagaacttggttcatacacaaccaattcatttaattaatcctcaaatattgttcaatgaagagtttctgaatttggaaaatattgattctcagcctatttccaaggaaacgaaaactacgaaggactgcacaatggcaactggtcctgaaagaggaaaaaagagctctgaaagtaccagatcctcttcattatcatctcttttttctaatgatgaatccgcatctacgttccactcatcattcaataaccatgataactttcaaaagagcaacagaaatggagatgatatcgatattagtgacacaataaaatatgaaactaatacaaatgcacaaaaagatatcaaaatattccaagaaaattttgaattcaatgaattcccatacacacaagacttctacccatataccaccaattatacctattcaaaacccacaaatattcatgaatcaataaattcaaaaaacacggattcatactcccaatatcaagatcagtttccaccacatactgataacatacattcctttaataatcgtcactatagcaaccataaaagcactaattgtaattactataataataccagcaataataacaacgcctccgataatgtatatgaggcagatccatttatagatgaacctcaggtgccctcctactattacccattagaaattgccttcgacgttgaaaaatcaccaccgccatcactacaaaaattaaattcaaaagagttagaattcctaaaaaagttgaactccaaactgtcaagatatgctgcggcttactccttcagcagttctaatgatcaagattattatgacaaggtcaggtttcaagaaatatcctacaagtttagtaaaacctattcttaattctcgaaaagtactacaatcttcccccttccctcaaaatatatccattcacactcatttctttatttccattgtctcactcaaattgctaagaatttgtgtatttgcatatatatatattatatataggtatatatatgtattcaatgtctcaagctccatgacataataccgtagcgttattagccttatcgtatgtcgcgatgggaaaggagattcgttttaatcttgaaaaaccttcgtagcgaataatgcgacataaatcttgagagagtacatcaccaaattcactttgttaaaccgcaccatcgtgctttgcattcttattccttttgcctacactaaaattattagcatttctctaaatgagctccagtgaagacgaagacgacaagttcttgtatggttccgactccgaattagcactaccttcatctaaacgatcaagagatgatgaagcagacgcaggtgcgtccagtaatcctgatatagttaaaaggcaaaaattcgactctcccgtggaagaaactccagctactgccagagatgatcgttctgatgaagatatctactctgactcctcagatgacgatagtgattctgacctagaggttatcataagtctgggtcctgaccctactaggttagatgcaaaactactcgattcttattctaccgcagcgacatcttcaagcaaagacgtaattagcgtagctacagatgtatccaataccatcacaaagacatcagatgaaagactaataacagaaggagaagcaaatcaaggtgtaacggcaacgaccgtaaaagctacagagagcgatggaaatgtaccgaaagcaatgactggttctatagacctggataaagagggaatctttgatagtgttggcataacgacaatagatcctgaagtattaaaggagaaaccctggaggcaaccgggggccaacttaagtgattatttcaattacggttttaacgaatttacctggatgga

SEQ ID NO: 58 - protein, 360 aa, Saccharomyces cerevisiae; identical to SEQ ID NO: 2

SEQ ID NO: 59 - DNA, 3938 bp, Saccharomyces cerevisiae
cccaatgccccacttttctcgaggagttgaaacaagcgggacaactgctacgtcataaaaatgggagtaccaagggaggagccataagccgggtaaaatttggcgctgtttttcttaatctaaaaatagttcaacaaaaaaatttgggctccgcccatccagaccaaagcaatcttcggccttaacaagccaaagggaacgaaacccagactctaccatgcatttcgaacatcttgtagctaactacactggtaacccagatacctattctctcagtagctgtttcaccaagactccgcactcatggtaagtagaaaaagaaaactctcacaaaaatctgagtggcacagcttttccaaatacgctttttaaacttggagaaataaagatgtattacccgctggtgccttaaaatatccttttctccggttgtccaataatttatgttacggcggctatttgagtttttgtggaaatctctatcattaataaatgtcagccttgtgtcttaaatgcaattcaacagggaaaaggcgcgagacttcggcggcaaaaagccacagacaagtgctggttgcaaagaggtaaagaagtaatgagtgtaatcaaatagatatattaaggtagcaactcaccggtctgtccattttcttttcctgaataacttcttctgtcttcacacattcatttcatttttattttccaatatcactcaacgagaaagaagttacaagatctatctttcaaaatagtttacagttacctttactttaccctttcccttttcagtttgttaccccttctcctaaaagttttattttttgggtaaagatataaaggacactccagtcggttaaggtggctgtctagagaatataaacctgtatttatttaccaggcttatcagaaaagttaatcgtgttcttaaatattcattgaaaaggaacgtgatacagacgtaataaaagaagagtactaagcttaacttaataggtcatttatggttgaaaaacgtagtagacagagttccagtagtggctcagagttcagtgttccacctgatgtcgataacccgccactttctatccctttgaagactttatcagacagatatcagctgatcgaaaaactaggtgcaggatcatttggttgtgtaactttagccaaagcgcaatttcctttatcgaacatattgggtaaacaacatgatataaggggtactttaatggatcagcctaaaaatggtcaccaaaactatataacaaagacacaaggtgtagtggctataaagacaatgatgacaaaactgcatacactccaggattatacgagggtcagagaaattaagttcatactggcaatcccagcgaatgaccatctgatacaaatttttgaggtctttattgactctgaaaattaccaattacatatcgtaatggaatgtatggagcaaaacctatatcaaatgatgaaacatagaaggcgccgagttttttcgattccttctttgaaatctattctatcgcagatactggctgggttaaaacacatccacgaacataatttcttccacagagatttaaaacctgaaaatattcttatcacaccaagtacccagtattttgaaaaggagtacatgaaccagattggatatcaagataactatgtcattaaacttgcagattttggtttggcacgccatgttgaaaataaaaacccgtatacggcctacgtttccacaagatggtatagatcgcctgaaatattattaagaagtggttactattccaaacctttggatatttgggcattcgggtgcgtggcggtggaagttactgtattcagagctctcttccccggtgctaacgaaatcgatcagatatggaaaattttagaagttcttggtacacctatcaaacgttctgattttgttaatacaaaccacatcacagctccaccacctggtggattttgggatgatgccagtaatttggtccataaattaaacttgaaattgccttatgtagaaggttcatcgttggatcatctactttctagctcccaactatccgatttatctgaggttgtcaaaaagtgtttaagatgggatcctaatgaaagggcaacagcccaagagctttgtgaaatgccattttttgaaaacaccgtggcagcccaagtagacgcaagaggcaatgtgactaatacagaacaagcattgatttttgcaggtataaatccagtagcgaccaacacaaagcccatatattttaactcttcaacaaaattgcccgcagaaacagagtctaatgatattgatatcagcaacaacgatcacgattctcatgctatgtgctcaccaacattaaatcaagaaaaactaactttggtagaatttttaaacgaattcgttgaagaagataatgatgatcgctcaatacctgatgttggaacagattctaccatttcagattctattgatgagactgaattatcaaaagaaattcgtaataatttggccctttgtcaactaccagatgaagaagtcttagatcattcattatcgaatattaggcagttgacaaatgatattgaaattataaataaagatgaagcagacaacatggaacagctattttttgacctggaaattcctgaaaaggatgagtttcagagaaaacaaccatttaatgaacatgcagatattgatgaagacatcgttctaccatatgtgaacaactcaaattacacacatacagataggtcacatcatagaggtgataatgttttgggtgatgcctctttaggcgattcgtttaattcaatgccagattttactccaagaaatttcttgatacctacattaaaaaaatcacgggaaaagttcgagcctcatctatccaattcaaaccaacattttggaaatgtaaccttctaataatttgtcatttgactgacgaatcgttaggcacagttatatagttatatacacatagacatacatatgttcgcatatatattatattactatgcattcacctaaatagctactgctctattaatacagtgcttttttgatggctttaatttaacttattagacattactttgcgtttattcccctccaatatatttttatgtttgtttttcttgaacattttatgatttcttgctcttggcggctactgattttgttaagcaactcatcaagaggtcaaaaaaagtagaacgagatctttgtgttcggttacccggctcagatcctaacttggtatgtttattcgtataagttactgttgtccacaggcaatactctgcagaaaattaaaacggcattaatgctaggacaaccagaactgttactactgtatgtgcgatagttgataactgcaacattatgcccggtatattctcaaaaaaccctattactgcatacgaagaaatcgcaagagaaatctttcggtttggaaaagctcactgtgaggttccttggagccaatagtaatacagcacaatccaaggaaaaatctggcctatatgcaaggaaggagagatagtcaaaagcattctttcccctagaagttggtgcatatatggcatcgttaaaacatattacccccaaaatttcttctctaaacgatgtgcttggcctttgttttggtttttgatgtcggtcgtttgaggccccttgcggaaaatcgagatcgccgaatggcacgcgagggaagggaaataaggtttaaaggcactgaaacaataggcaagaagtaggcgagagccgacatacgagactaatgtgtccgcgtttctaaggccacttttcaatggaacggatattgatatgctagtaaaaggacgagctcaagagcgaaaatataagtaaagaattcgagtgcacttgtctccatgcagcaagatttcatatgagtcttttttat

SEQ ID NO: 60 - protein, 645 aa, Saccharomyces cerevisiae
MVEKRSRQSSSSGSEFSVPPDVDNPPLSIPLKTLSDRYQLIEKLGAGSFGCVTLAKAQFPLSNILGKQHDIRGTLMDQPKNGHQNYITKTQGVVAIKTMMTKLHTLQDYTRVREIKFILAIPANDHLIQIFEVFIDSENYQLHIVMECMEQNLYQMMKHRRRRVFSIPSLKSILSQILAGLKHIHEHNFFHRDLKPENILITPSTQYFEKEYMNQIGYQDNYVIKLADFGLARHVENKNPYTAYVSTRWYRSPEILLRSGYYSKPLDIWAFGCVAVEVTVFRALFPGANEIDQIWKILEVLGTPIKRSDFVNTNHITAPPPGGFWDDASNLVHKLNLKLPYVEGSSLDHLLSSSQLSDLSEVVKKCLRWDPNERATAQELCEMPFFENTVAAQVDARGNVTNTEQALIFAGINPVATNTKPIYFNSSTKLPAETESNDIDISNNDHDSHAMCSPTLNQEKLTLVEFLNEFVEEDNDDRSIPDVGTDSTISDSIDETELSKEIRNNLALCQLPDEEVLDHSLSNIRQLTNDIEIINKDEADNMEQLFFDLEIPEKDEFQRKQPFNEHADIDEDIVLPYVNNSNYTHTDRSHHRGDNVLGDASLGDSFNSMPDFTPRNFLIPTLKKSREKFEPHLSNSNQHFGNVTF

SEQ ID NO: 61 - DNA, 3884 bp, Saccharomyces cerevisiae
atattgttttttccctagctgttttcggtttggttatgaacgcattgtctgcgaaaagaaacgtggataagtattatagaaacagcacttcttcggccaacaatatcacgcaaattgagcaagatagtgctataaaaggtcttttgcccttttttgcctattatgcaagcatcgctttactagtgtggatgcaaccaagctttattacactctctttcatcctttccgttggtttcacgggagcatttaccgtcggaagaataatcgtttgccatttaactaagcagagctttcccatgttcaatgcacccatgttaattcctttgtgccagatagtattgtacaaaatatgtctatccctttggggaattgagtctaataaaatcgtctttgccctatcttggcttgggttcggtctctcactaggtgttcacattatgtttatgaatgacattatccatgaatttactgagtacctggatgtttatgctttatccatcaagcgctccaagctgacataaatcgcactttgtatctacttttttttattcgaaaacaaggcacaacaatcaatctatcgccctgtgagattttcaatctcaagtttgtgtaatagatagcgttatattatagaactataaaggtccttgaatatacatagtgtttcattcttattactgtatatgtgactttacattgctacttccgcggctatttgacgttttttgcttcaggtgcggcttggagggcaaagtgtcagaaaatcggccaggccgtatgacacaaaagagtagaaaacgagatctcaaatatctcgaggcctgtcctctatacaaccgcccagctctctgacaaagctccagaacggttgtcttttgtttcgaaaagccaaggtcccttataattgccctccattttgtgtcacctatttaagcaaaaaattgaaagtttactaacctttcattaaagagaaataacaatattataaaaagcgcttaaaatgaatgaaatggaaaacacagatccagtattacaggatgatctcgtatccaaatatgagagggaattaagcacagaacaggaagaggatacgcctgttatccttacgcagttgaatgaagatggcaccacttcgaattatttcgacaaaaggaaactaaaaattgcccctagatcaacactacagttcaaagtgggacctccatttgaattagtgagagattattgtccagtcgttgagtctcataccggaagaacactagatttacgaattattccaagaattgacagagggttcgaccatattgatgaagagtgggtaggttataaaagaaattattttaccttagtatcaacgtttgaaacggcaaattgtgatttggatacttttttaaagagcagttttgatcttctcgttgaagactcttcagtagaaagcagattaagagtgcaatatttcgctatcaaaataaaagctaagaatgatgacgacgacacggaaatcaatctcgtccagcatacagcgaaacgcgacaaaggtcctcaattttgtccttcagtatgtccgttggtgccttcccctttgccaaaacatcaaatcataagagaagcttcaaatgttcgaaatatcactaaaatgaaaaaatacgattccactttttatttgcacagagaccacgttaattatgaagaatatggagtggactctttattgttttcctatccagaagattctattcagaaagttgcccgttatgaaagagttcaatttgcttcatcaattagcgtgaagaaaccatcccaacaaaataaacactttagcttgcatgtaattttaggtgcagtggtagatccagatacctttcatggggagaatcccggaattccttatgatgaactggctttaaaaaatggatcaaaagggatgtttgtgtatttgcaagaaatgaaaacgcctcctcttattattagaggaagatcaccttctaactatgcgtcatctcagcgaataactgtgagaacaccgtcgagtgtcaattcctcacaaaacagcacaaaaagaaaaatgccatcaatggcgcagccgttaaatgaaagttgcttaaatgcaagaccttcgaaaaggcgatccaaagtggcgctaggtgcaccgaactctggggcctccatctcgcctatcaaatctcgtcaatccacaccaatggaagcttcgaaggaaaatgaggatccgttcttcaggccaaataaaagggtggagactcttgaacatatccagaacaaactgggtgctttgaaaaatcaatgtccagattcctctctgaaatatccgagttcatcttcaagaggtatggaagggtgtttagaaaaggaggatttagtttactcaagtagtttttctgttaatatgaagcaaatcgaactgaaaccggcacgctcttttgaacatgagaatgttttcaaagtaggctcattagcattcaaaaaaatcaatgaattacctcatgaaaattatgatataacaatagagaagaaatcaatggaacagaattatctaagaccagagataggctcacgttctgaatgcaaaacaagctatggtaacgaactctccctttcaaatatttctttctctatactacctaattcagcagaaaattttcacttggaaactgcacttttcccagctacggaagaggatgtgccaaggacattttcaagaatattagaaacaggttcgtttcaaaattattatcaaaaaatggatgcagaaaatgcagatagggtatattcgaaaggggtcaagttgattgcaagcggtactctaccatctggtatatttaatagggaagaattgtttgaggaagatagtttctataagtattaaataaactaatgattttaaatcgttaaaaaaatatgcgaattctgtggatcgaacacaggacctccagataacttgaccgaagttttttcttcagtctggcgctctcccaactgagctaaatccgcttactatttgttatcagtaaccttcatatctacatagaatagcttaagtgttttattagttgccagaagaactactgatagttgggaatatttggtgaataatgaagattgggtgaataatttgataattttgggattcaattgttaatcaatgttacaatattatgtatacagaatatactagaagttctcttcggagatcttgaagttcacaaaagggaatcgatatttctacataatattatcattacttcttccccatcttatatttgtcattcattattgattatgatcaatgcaataatgattggtagttgccaaacatttaatacgatcctctgtaatatttctatgaataattatcacagcaacgttcaattatcttcaattcggcttcagtactgcatgaaatactcgctaacattttctttattctataatagcacagtgacacttaaacgtcaaacgtggcgcacattaatatacgatgtatgcatttggcttgacactgctgtaataaggaacatcatcatccatcaactagtagtcacattagtagtgtattatcacatggtgtgtaagaacattacataaagattgaaaaaaagtcatcaaaaataaaggaagctgaaatgcaaggactagtagtgtaatataataatattgtgtagaagtatcgataccctttttggaattattgtatcttcgagggtggcttttaatatatttttgaaaacctaatattataacctttcacaacaacgaaatcccaactgttgtgtaataattttactcaattcttactattgctttatcaatccttgtatttgagctctcataaagttcgctgactacttctcacgactcatgtcatc

SEQ ID NO: 62 - protein, 627 aa, Saccharomyces cerevisiae
MNEMENTDPVLQDDLVSKYERELSTEQEEDTPVILTQLNEDGTTSNYFDKRKLKIAPRSTLQFKVGPPFELVRDYCPVVESHTGRTLDLRIIPRIDRGFDHIDEEWVGYKRNYFTLVSTFETANCDLDTFLKSSFDLLVEDSSVESRLRVQYFAIKIKAKNDDDDTEINLVQHTAKRDKGPQFCPSVCPLVPSPLPKHQIIREASNVRNITKMKKYDSTFYLHRDHVNYEEYGVDSLLFSYPEDSIQKVARYERVQFASSISVKKPSQQNKHFSLHVILGAVVDPDTFHGENPGIPYDELALKNGSKGMFVYLQEMKTPPLIIRGRSPSNYASSQRITVRTPSSVNSSQNSTKRKMPSMAQPLNESCLNARPSKRRSKVALGAPNSGASISPIKSRQSTPMEASKENEDPFFRPNKRVETLEHIQNKLGALKNQCPDSSLKYPSSSSRGMEGCLEKEDLVYSSSFSVNMKQIELKPARSFEHENVFKVGSLAFKKINELPHENYDITIEKKSMEQNYLRPEIGSRSECKTSYGNELSLSNISFSILPNSAENFHLETALFPATEEDVPRTFSRILETGSFQNYYQKMDAENADRVYSKGVKLIASGTLPSGIFNREELFEEDSFYKY

SEQ ID NO: 63 - DNA, 3197 bp, Saccharomyces cerevisiae
taatgcccattatgccaataaagacttgccgctacatacggatttaccatttttagaaaatgtgccaggtttccagattctacaatctctacctgctacagaaggggaagatcccaatactagacccatgaattacttcgtggacgcattttatgctacccgtaatgttagagaatcggattttgaggcttatgaggctttacaaattgttcctgtaaattatatatatgaaaacggcgataagaggtactaccaatccaaacctttaatcgaacatcacgacattaacgaggacaatactcttctgggtaattatgaggccttgattaaatgcattaactactctccaccataccaagcacctttcactttcggaatttatgataagccctcagatctaaataataatccggacttgaatttaattaccaccccagcaaaactaacagagagatttttgtttaagtctttcattagggggttgaacttgttcgagagtcatatcaatgacttcaacaatcaatttagattgcagttgcccgaaaactgttgtgttatctttaacaacaggagaattttgcatgctaactctttaacaagctcaaaccagcaatggttaaagggttgctatttcgattctgatactttcaagagtaaattaaagttcttggaagagaagtttcctcatgacaaataacttcattttttcagcatagttatgtgattctttatatttatttattttctctctgtgtagtgacaatttttttttaatgtttcatgttaaatatatttatattaagaagccgtcagtttccttttgtttcattgaaatcaataactaaaattaaaattataaaaggaataacgtaaaagaaagtctactacccaaggaaaatctactttatttagtgattatattcaactaaatatcattcaaataacctcacatatttgtcttcacccttaagattttacgatttactaagttcaccttctcatggctttggagggattgcggaaaaaatataaaacaaggcaggaattggtcaaagcactcactcctaaaagacggtccattcacttgaactccaatggtcactccaacggaactccctgttcaaacgcagatgttttggctcatattaagcatttcctgtcattggcggctaattcattagagcaacatcaacagcctatttcaatcgtctttcaaaacaaaaaaaaaaaaggcgatacaagcagtcctgacattcacacaacattggacttccctttgaatggcccgcatctatgcactcatcagttcaagttgaaaagatgcgcaatccttttaaacttattgaaagtcgttatggaaaaattaccgctaggtaaaaacactacagtgagagatatcttctactccaacgtggaattgtttcaaagacaagcaaacgtagtccagtggctggacgttatacgctttaatttcaagctctctccaagaaaatccttaaacattataccagctcaaaagggtttagtttattcgcctttccccattgatatttatgacaatattctgacatgtgaaaatgaaccaaagatgcaaaagcaaacaattttccctggtaagccctgtctaattccatttttccaagatgatgcggtcatcaagttagggacaacaagtatgtgtaatattgtaatagtggaaaaagaagctgtcttcaccaaattagtaaataattatcacaagttgagtacaaataccatgctcattacaggtaagggatttccagatttcttgacaaggttattcctaaaaaaactagaacaatattgctccaaattgatatcggactgttctatatttaccgatgcggacccctatgggattagcatagccctaaattatactcactcgaatgaacgcaacgcttatatttgcacgatggcaaactataaaggaattcgtattacgcaagttttggcacaaaataatgaagtgcataacaaatccattcaattattgagtttgaatcagcgcgactactccttagccaagaatttgatagcatctctgactgccaacagctgggatattgcaacttcaccattaaagaacgtcatcatagaatgtcagcgggaaatttttttccaaaagaaagctgaaatgaacgagattgatgccagaatttttaaatacaaatgaataagaatgggagctgttgctttataaaaaatgtttttcaagaattgaaaacggttacatttaaatattatataaattgaaatctttgataatgaatactagtccaaaaaaaaatacaatttcaaaaaaataaatgccatctcctagaatcgaaccagggtttcatcggccacaacgatgtgtactaaccactatactaagatggcatatgattttacaatgattcgatggtgaatgagttataagccatgtaaggatcactagtcttttttcttaagtaactttttcgcttgtgatatcttgaaataccattaaacatagataagctattgaaatgtgaagaaaattcaaaaaaaaaagggaacagagtcatcttttgggtagaaactaagcttcaatggatgaatgtttacccaattcatgtctactaggtgttcacctcgtcatttcaacgcattcggggccacaaatagtttatcactacccaccctccaatacagcatttctaacaaataatccaacgaagcatcagcacctctatggaaaccatgcaaatctaaataaaaacacaagtacaaataaagaagaaaaactctttaattctggctctacgaaaacagcttctcaaattgctctaaacgagtcagcgaaaagttacaataccgctattacgccatcaatgacaaatactaatactaataatgtgacattacctccaactagatcacatgctaatactgtaggatcacaaagttcaattcctgcggctactaatggtgtaggttatagaaaaaccgatatcgaagatacttctcggacttttcaataccaagaaactgaatctgaaacgtcatcatcgggattaagtgacagcgaattgtccacagactacttagacatttctagcgattcgttttctatatcttcttccttatcgtcatcttctttatcttcttctccctcaagttcatcctcatcttcccctccgcaagatggctta

SEQ ID NO: 64 - protein, 398 aa, Saccharomyces cerevisiae
MALEGLRKKYKTRQELVKALTPKRRSIHLNSNGHSNGTPCSNADVLAHIKHFLSLAANSLEQHQQPISIVFQNKKKKGDTSSPDIHTTLDFPLNGPHLCTHQFKLKRCAILLNLLKVVMEKLPLGKNTTVRDIFYSNVELFQRQANVVQWLDVIRFNFKLSPRKSLNIIPAQKGLVYSPFPIDIYDNILTCENEPKMQKQTIFPGKPCLIPFFQDDAVIKLGTTSMCNIVIVEKEAVFTKLVNNYHKLSTNTMLITGKGFPDFLTRLFLKKLEQYCSKLISDCSIFTDADPYGISIALNYTHSNERNAYICTMANYKGIRITQVLAQNNEVHNKSIQLLSLNQRDYSLAKNLIASLTANSWDIATSPLKNVIIECQREIFFQKKAEMNEIDARIFKYK

SEQ ID NO: 65 - DNA, 3194 bp, Saccharomyces cerevisiae
aaaaagccgtttgcggaaagcaatgttttgcccattcagaaacaatatctttgctgtatccctacatgtattatgccgcgttgcttgtgcaggtacggagtccctgcacgatttttcaacaaggtctagatttgctaagacgatgaggcggagcccgaaacaaacaagccaaaaaccggaatttcgcgcttggtgtgctttcgcatcttttcgtgtggtgaatgcacctggtgcacgctgcgaaggtgacgtagcaatccaaaaaagggaagtctaggcgctttcaaccgccccccaccgtgcatgcggattggttgtcacaattcgcagacatattggcaatgtttcctcccctcctgttgatgcgggtaaggggtgtctgttatgcaggaacaggaaggtaaaaattaaatgggccttaattctgtagacactctcttggggtaataaggttaaaagccattgttgaagtacggaatcatctcttcattttttcagcgcttgtaaggaattaatccccaggaaggtgccgatgtaatgagagaagtattcttgttgtatctctttggttcggagtatttccttctttcttttctttgtagtttttatgcaaatgcagggaacagagtacccggttaaggctgttagtcagccgcactctacacaaaattacttggcaaacacgttggttgggaaaagctttatacttggcggtgtagtaattgtaaaggatcaagattgtgtcatgctaatgtgccgctgtgtaacaacctttttgaagcgcgtatttaccaccggcaaaaggccattgtgtcacataaaaaaaaactcccgccaaagccaggttcattttgcataagattcaccacagtacggaaaatacgataagttaaccagtaatttgctcgctttagctactgataaaccttctctgttaacactattatttttttattactttagatttttccgtttgtgaatagccatttttagatatataatggggttcagaaaaatacttgctagcaaatcgcatcacagtcgccaccataatcagcaccataagaacctgaagttgcaaaatcatcgctatgtacttatttccaatattacaggatcccatgaaacaaaatatttatcacccttcaggatggacaattgttcaggaagcagaagacgtgataggctacatgtgaagcttaaatccttgaggaataaaatccacaaacaacttcacccaaactgtcggttcgatgacgccactaagactagtgatgataaatgcgtctcttatgaggtgcccgaaagggatggccttgctactatttcgttagaagaggtttttccaaagtccaacaggtgccaaatacctgaagaaaacttgggagaaacagatagcgttattcacagagatttgggaaattttgcaaatgagaatgactatccacagtggagaaaagttgaaagtcaatataacttagagaatgtccagcctgaggaggatgaaatagttgatagactcaggtccgagattagaagcactaaattaaaatctgtaaaaacgacaagcagaacacttgaaaaagctatagaggctcgatgtactggaaagagagttcttcaacaactaagttgtcagagcaaccaactcaccaagatcgagagcaattgtgacatgcttaaaattcaatctaacgtagccgaccgaaagattgacgaacttgcccatgaaaatagaagcctgcttgcattaaaatcacccaaccccttcaggaagaaaagggagagagaaaagcgagaccagatcaacaatttgaagttaaagcatcgtcacttacagcaagaaactatgaaaagagcccaagattctgacaaaaatttagccataaatctaagttctgaatatggacggtatggccaaggggtggaaagacagcgtattcttagagatgcccagaagtatcagtttgaagccgatgaagaagataaccaaatggaaatcgacttgtacggaaacctagaacaaataaaagcggtgagtggtgacttgaaaattatggctcacgcttttggcagagagtttgaagcacaaaacactagaatgtttgacatcgagaacaatgtacagcaggcagataatgctttacaggccaagcgatatagattggagaaagtgatcgggaaaagatggtgatctgttatacacacaaaatatcgtgtataaatatattgaataaatagtttctaaaaaggcatacgcagatattcttgcgaaagagaaaaaaaaaagagcgagggggacattagtactgaaggtctcaattcttctttgtattttctttcggagttgtcagacaaagctttctctttcccataaataaagtgcattcaaacatcggcaggtttgtttttcccagttgttacgtatttgtttcccgttccattcatgatcttaaactgggttaactgaaaaatcaacatgattttgtgaaaagtaaaagagggtaagaaagatagataccgctgtcgtgggactatattttttacagtaccaagtctacttgcttctcataaagttgataagttataattcatataatttcatttgtcaaaaaagattttagttacaaaacgatatcaaagttcaatcttgttgggaaaaaggaaaacattatgaagggtttccggtaatcactgcgtatgccacactattcctatagaattgtcttgattgggtgcttatgctgcggaaaaattatattctgcgcttgccttttatattaagcgtcacaacgcccttaccaagatcgagcggattaagacaagagtgtatctcaagcgtccgtatatgtttaagttgaaaaggatatttagtaagaataattctaccctacaaacgatattagtaaaaaaaaaaatcaataatagagttattgtacaaacatgttctgaaaattggaagcatcacatcgtatgctactagagaaaatttttactatccttttttccacaagcccagccctagcccgatcatcctattaattgtcagaccaccgaatgctatcccgccacggttgatataacgaaactctttactgctttgggtcaaatatgcctcttttccgcattttttcggagtagttcattgccgcatacataccgcaacttggacgaggatgtcctccttctcttac

SEQ ID NO: 66 - protein, 397 aa, Saccharomyces cerevisiae
MGFRKILASKSHHSRHHNQHHKNLKLQNHRYVLISNITGSHETKYLSPFRMDNCSGSRRRDRLHVKLKSLRNKIHKQLHPNCRFDDATKTSDDKCVSYEVPERDGLATISLEEVFPKSNRCQIPEENLGETDSVIHRDLGNFANENDYPQWRKVESQYNLENVQPEEDEIVDRLRSEIRSTKLKSVKTTSRTLEKAIEARCTGKRVLQQLSCQSNQLTKIESNCDMLKIQSNVADRKIDELAHENRSLLALKSPNPFRKKREREKRDQINNLKLKHRHLQQETMKRAQDSDKNLAINLSSEYGRYGQGVERQRILRDAQKYQFEADEEDNQMEIDLYGNLEQIKAVSGDLKIMAHAFGREFEAQNTRMFDIENNVQQADNALQAKRYRLEKVIGKRW

SEQ ID NO: 67 - DNA, 3875 bp, Saccharomyces cerevisiae
ttatttcaagcatttttggtgttgttggtgcgggtatattaaccctattgaacaataatgccaataactctgctcacatcggccttttgatattacctggcgttgctttcggtggtttggcacaaagttccatgctcgcttctcaaattcagttagacaagaagagcccaacttttcgatcagattttgtctctattaccacttttaacacattttgcaaaaatctaggtcaagcactgggaggtgtcatctctaacactgttttcagtgctgctgctatcaagaaattaaccaaggctaatattcagctcccagatggtaccacggtagacaatctggtaatctataggcagaccaatttcgatggctctcattccaaattgggcaatataatttctgaatctctcactgacgtcttttacatggcattaggattttatgcattatctctcatttttgctgtttttgcttcaaataagaaagtcacagcaagcctgagataagttaagcacgatctagaaggtggcgagcctcaaagtataaagctgcagaaaaaataaacatgacttttagtaattggctgtttagcttgctgaattgtgtaccacaactaacgataacagtaagagggtaatccgagacagtatgagtacagctattaaatagttaatttagatttttatactggtatgataaacgacgttcatatagcaagagcgtcaatgcctctatgtcaccttcaatagaagtttccctttttatttcgacttttgtttttgtatttttcggcgtctgccttgttccatttttaaggcgccaaaaataaaataaaatgaagaacgattagtactcaaagaacactttaatccttggaaacaaaaaaataaaaaatcaaaagttgaaggaaggtcaaattttcttcctccaacgataataatacttgcttatataactcttttaaagttttacaaaactttggatcagaaaaaaagaaaaaaatatggctactccccatttatattacagatataactccaaaagctctaacaaaaatatcaattctagcggaaattctacagaggttgaccgtttcattccaaaatcagtttcgagaaatgcttataagtctattccaatgttaaatgggtttgacataagttactcagaactttgcgagaaatctccttcacctgagcggctatcatcccctgaattctttaacgaactgcgaaacaccgggcattacgaatcaatcagtacaacaaatgagttttccatgtcaagtatctctagctcttctgagagtcaagttaccagaagtggaagtgcaagagcttcaagaaacgattattcaaaattaactaaagagcaaaaggaccatagaaagaatattgcacattctcttggttttcaattgcccgaccgtgtctttacgtttgagaccacaagtgctgaaattctggaaaagaataaagccatcaaaaattgctttggaccaggaagttgcgccgaaataagatcaacctttgactttagtacactctcgcccgatgttgcccgttattatatcgctaattctaacgcaagatcagcttccccacaaagacaaatccaaagacctgctaaacgagtaaagtcacatattccataccgtgtattggatgcaccttgcctgagaaatgatttttattcgaacttaatttcttggtcaagaaccacaaacaacgttttggtgggactgggttgctccgtatacatctggtctgagaaagaaggagcggtatctatattggaccatcaatacttaagtgaaaagagggatttagtgacatgcgtctcattctgtccttacaatacttattttattgttggtacaaaatttggccgtattcttctttatgatcaaaaagaattttttcattccagcaacacaaacgaaaaggaaccagtatttgttttccaaactgaatccttcaaaggaatatgttgcctagaatggttcaaaccaggtgaaatttgcaaattttatgttggagaggaaaatggcaatgtgagcctctttgaaataaagagtttgcatttccccataaaaaactggagtaaaagacaaaaactcgaagatgaaaatttaataggattgaaacttcattccacttatcaagctcaggcacagcaagtctgtggtacgttattaagagcttatgctttcacatacccttttctggtatagcgcttattttttcattatgaaaaatactaacaaatattttctacaggtatttctctgaatgaacatgcaaacctgcttgcagtcggcggcaatgataattcttgtagcttatgggatatttccgacttggataaacctattaaaaagtttgttcttccacataaagcggctgtgaaggccattgccttttgtccttggtcgaagtctttgttggctacgggtggtggaagcaaagacagatgtattaagttttggcatacatcgacaggcacattgttggatgagatttgcacctcgggacaggtgacgtctttgatatggtcgttgagacataaacagattgttgctacttttggattcggtgataccaagaatcctgtattaataacactatactcatatccaaaattatcaaaactactcgaagttaggtcgcccaaccctttgcgtgtactgagcgcagtaatctctccaagttccatggcaatttgcgttgccactaacgatgaaacgataagattttatgaactgtggaacgataaggaggaaataattaatgaaattcaagagagtgggatttatggatctaatattatagaatatatggagggtatcgaaacaacacataacaaaagaataaggtaatataaaaaaaggatattcattgcacgcacaaaccaaatacttcaaatagcaaactaacagtaagaatatataaaactatacatacgtatacataaaaaaataatagggaaaaaaaaaggaaaccatatgagtttgaatgaggcgacgtgccatattaaacaattatattttaacacttccgcactgcacctatttagttggctgatttgtgacgtttttaattccgatcggcctgaaacagcgaagggtcctggaaaattaagataataaaacgaaatgaaacccagcaacgttagatgatgctcaaaaaaatatagagacagagaaaaaccagaatacaaagagctgtttaagtggtcaatatcccaggtacaccgagcccagtcacatcgaacttataatggatgcaaagaaaaatactggtgaagccaataatgatgtattggaagaggaagcagcgattcagttgattgcaccaggtatagcgagaaacttaacacaagaagtcattaccggtatcttctgtaatgtagtaatatatcctcttcttctaatatattttgtcttaactttccgttacatgactacaaatattgtaccttatgaatttatagatgaaaagtttcacgttggccaaactttgacctatttaaaaggtaaatggactcaatgggaccctaaaataacaaccccccctggaatctatattttgggtttaattaattattattgtataaagcccatattcaagtcgtggagcacactaaccatactaagattagttaatttacttggagggattatcgttttccccattttagtactcaggccaatattcctttttaatgccttaggtttttggcccgtttcattaatgagcttcccattgatgacaacttattattacttattttacaccgatgtgtggtctacaattctgatattgcaatcactcagctgcgtgttaacattaccgtttggccccgtgaagagtatatgg

SEQ ID NO: 68 - protein, 593 aa, Saccharomyces cerevisiae
MATPHLYYRYNSKSSNKNINSSGNSTEVDRFIPKSVSRNAYKSIPMLNGFDISYSELCEKSPSPERLSSPEFFNELRNTGHYESISTTNEFSMSSISSSSESQVTRSGSARASRNDYSKLTKEQKDHRKNIAHSLGFQLPDRVFTFETTSAEILEKNKAIKNCFGPGSCAEIRSTFDFSTLSPDVARYYIANSNARSASPQRQIQRPAKRVKSHIPYRVLDAPCLRNDFYSNLISWSRTTNNVLVGLGCSVYIWSEKEGAVSILDHQYLSEKRDLVTCVSFCPYNTYFIVGTKFGRILLYDQKEFFHSSNTNEKEPVFVFQTESFKGICCLEWFKPGEICKFYVGEENGNVSLFEIKSLHFPIKNWSKRQKLEDENLIGLKLHSTYQAQAQQVCGISLNEHANLLAVGGNDNSCSLWDISDLDKPIKKFVLPHKAAVKAIAFCPWSKSLLATGGGSKDRCIKFWHTSTGTLLDEICTSGQVTSLIWSLRHKQIVATFGFGDTKNPVLITLYSYPKLSKLLEVRSPNPLRVLSAVISPSSMAICVATNDETIRFYELWNDKEEIINEIQESGIYGSNIIEYMEGIETTHNKRIR

SEQ ID NO: 69 - DNA, 2727 bp, Saccharomyces cerevisiae
caaaaaatgtatacaaactcttaggattggtcaagaaaagtaaatgttgtactgctccaaagatattgcgatgccgtgataattcaaaagggtcgacccagtctatttcactcgcgcgataatcgttcgttatccgaagctggccaattgatacaattaattgacatcagcagacagcaaatgcacttgatatacgcagcttaaagcaagggtaaattatctgaaaaaggattgaatacaatcaaaaccttcacatacattggtagtaatatcgagcatcgctattagcagagtatctcgaagtctaccacggcgaaagttgattttttatctgaggtgctgatcttcggacgcaatgcgcaaacgtaattccgtagttttcccaattattttattttttaaattacacgtaccaggtagatcacatacgtatacccaacacctgttatatagtgaattgaattattcggaacatcaataatcctttgcttataattcttgttatcatccatcttgcatctttatttaattatattttgcacaataagctatctatgtgagctgcgtacggtgactccaaacaatctgttaatttccatataaataacttgtagtcggatcgtacaatggctctatataggtttggaccggtatgtaacctaatatggctgactcaaaacctgctagatagttatccaagtgaatttgagtctcgtatcctttatcacatttttacaatagtggctagctatctttttcatgttaggctcacccggtattctcatgcaagatcaaacaaaaaatggtaaagttttggactttacattgcttacagttgcttttttatgaagattcaaaagattatgtcctcggcggctaaattttccattaataatattatccttttacgcgaccgaaaaagagaagcgttttaagagttgtttctaacaaatattaataataaagctaacgtgaactgaccaggctctatttgaaagatatggcaccgaaaaagaaatcaaacgatagagccattcaggcaaaaggctcagaaggttaagtatttttttacatgctcatcaaataccgccattactaacaattgtaccccgggtattttatcagctgaacaattaatagaagattacttggtgtcacaatataaaccattttctgtaaatgatatagttcagaatttgcacaataaagtgacaaaaacaacagcaaccaaagcattagaaaatctcgttaacgagaaacgcatagtgtctaaaaccttcggaaagattataatttactcttgtaatgaacaagatacagcattaccaagcaatattgatccttctcagtttgattttgaaactgtattgcaactgagaaatgatttaatagaactagagagagataaatcaatggccaaagacgctcttgactctgtaactaaagaacctgaaaatgaagatctcctaacaatcattgaaaacgaagaaaacgagttgaaaaagattgaatcaaaattacaaagtctacaggatgattgggatccagcaaatgatgagattgtcaagcggataatgtctgaagatacgctgctacaaaaagaaatcacgaagagatcaaagatttgcaaaaacctaattgctacaataaaggactcagtgtgcccgaaaaatatgaatgaatttttggtatgtattttgaacatttttcgaaaccttttcttttgaatatactaacgaaatctttacaggaagaaattggatttgaggacatttgatgtgaaaagcaattggttgttccgtaccggaacacttgctattttacttatcatgattgtttttttttcttattctttgctattattatcaaattatatataggtaaataatcttacactagtttataagtgtcacgaacgatgaaatggaaacttgggggggaaggctcaaaaaacatactgtgtgtttatggggctgcctttgctagttgttgaggggtgagaaccgcaattactgacaaacgttactgatttgtaatattcaaaaactccttgcattgccttcccgttggccaaaatagtagtcgttgacaaagagtacggcgtcgattctaaagttggtgaggggatttgctcgcatatagttgtcagttcctgtgctaaaactgaagcaataacagaaaatattgaaaaacagcgaagtaactgcatcttaattgaaaatgtatgaagtaggtataatattttggcacacaagtgactgttgagagcttacaatcattctagaatgaggaatacgtcaaaatggaaacttaacatatcacctcttcttacaactatttatattgtatatttacaagggaaatcaattgcctgatattcagtatattggatctgaaggtatgaaacagtcccttaattaagctttagatgcggacagaagtttttttgttaaacttgcatgtcaaatttcaaactgcgtgtaattaccgtattcggaaattacatggtttcagtaattttgcaataaacgcagcaaccggtgatggcgaagttttaccatcaaacaataacttataataactgaatgccggcaggttgaaacaaattcttgaaaattagtcatttattctattgtgcgaatgtaatccactgaaatcatctaaagcaccattaccattgtctagcctgtgaataaaaaaatatgggagtataatgatagagaagtg

SEQ ID NO: 70 - protein, 218 aa, Saccharomyces cerevisiae
MAPKKKSNDRAIQAKGSEAEQLIEDYLVSQYKPFSVNDIVQNLHNKVTKTTATKALENLVNEKRIVSKTFGKIIIYSCNEQDTALPSNIDPSQFDFETVLQLRNDLIELERDKSMAKDALDSVTKEPENEDLLTIIENEENELKKIESKLQSLQDDWDPANDEIVKRIMSEDTLLQKEITKRSKICKNLIATIKDSVCPKNMNEFLVCILNIFRNLFF

SEQ ID NO: 71 - DNA, 3830 bp, Saccharomyces cerevisiae
ggctgtctttattgttcgtgatactttggttggccggcgatgtctttaaccttatgggtgccgttatgcaacatcttttgtctaccatgatcattcttgctgcttactatacggtggcagatatcattttactaggtcaatgtctatggtacgataatgaggaaaaaccagcagtagaccctattcatctctcccctgccaatccaataaacgaaaacgttctgcacgatgtgttcaatgaacaacaaccgcttttgaattcccaaggtcagccaaatcgtattgatgaagaaatggctgctccttcatccgacggaaacgttggtgatgataatctccgtgaagtcaattcaagaaatttgataaaagacatatttattgttagtggtgtagtttttgtaggtttcatctcgtggtatgtaacctactgcgtaaactacacgcaacctcctcccgtggaggatccatcactgcctgttcccgaactgcagatcaattggatggctcagatattcggttacttaagtgcccttttgtatctgggttcaagaattcctcagatattactgaattttaagagaaagtcttgtgaaggtatcagtttcctattctttttgttcgcctgtttgggtaataccacatttattttctctgtgattgtcatttctttagactggaagtatctaattatgaacgcttcctggttggttggaagcataggtactttattcatggatttcgtcatattttcccagtttttcatttacaaaagaaataaaaaatttatactgaattaacatgttctatctaatatttatttaacatatttttgacctcacaaactttttttttttttttctctgtcattgacatttttttaatgtcacaaaaagaaaaattaaatgtattataaaatttcatttaaataggaaaaaacccgtgattactaaaggcatattaaagatctattaaagatctattaaagctttctgctaccagtatggataatattttaaaggcatcaaatatggaagggacttcaacaatgacagttacctcgcgtagttctgaagactctagttgtatctcaaatcatgaacaagataccgatacacataaggacggcgacacaagtggtctggaaaacagtaaaatttcgaagagaaagtggatgaaagagtttttcaaactttccaaatctccagcttccaaaagcaaccggagtataggttccatgaaaagtaaccagagcctcgtttcaatgaaaagtagtgacgatggcaacagttataaaaatgattactcttctatctgtggtaacagccttccatctgcaggcttgagtcgttcgaatagtgtgaaagaattaaaattagattcaactggaagtcagagatcaaaaaataatgttgccatgttagcacgttcttctacaacatctcagacaacgtgctcttcttcttcatcatcatcttcttataactctataaaaggaaatgaaaatgatattttattgcagaataacaatcactttaggcataacaaagaaattcctcaaagtaaagggagctccaacattaacaccgcatcgattatgagccaatacaatgtcgatacgcaagcaaccgctataatgagcgatatgcaaaagcaatacgactcgcaacagatgacatcaccatttgtaaacgaagacttgcatttcgatccaaatggtgaagtttcacacgtaataaaagcaatttttaaagaaattggttataaatacgatgatttcagtgatattcctgtttttcaattaatgcaagaaatgtatcaactagtgaagaagaattccagcgctagaagaacaaagataacagactatgcttctaaacttaaagaaaaagaaacgcaactaaaaagtcaaaatgacaaaattttgaagttagaaacaacaaacaaggcctacaaaactaaatacaaggaggtctctctggaaaataagaaaataaaagaggctttcaaagaactagacaatgagtcatacaatcatgatgaggaattactaaaaaaatacaaatatactagggaaaccttagatagggtcaatagagaacagcaattaatcattgatcaaaacgagtttttgaagaaaaatgtcaatgaactacaaaatgaggttaatgctaccaacttcaagttctctttatttaaagaaaaatatgcaaaattagcagatagcatcactgaattgaatacctctacgaaaaaaagagaggccctaggagaaaacttaacttttgaatgcaatgaattaaaagaaatatgtttgaaatacaaaaaaaacatcgaaaatatatcaaataccaataagaatttacaaaattcgttcaaaaatgaaaggaaaaaagttttagatttgagaaatgagagaaatttgttgaaaaaggaaatactgttgattgaatgtcatggttcatattctctactccttgtatctaatattctgacatgttatcggttcttactgccaagtgatactattattgaaactgaaagcttaattaaggagctactcaacatgaataattcactttcgaaccatgtgtcttcttctgacgagcctccagcggagtactcgaaaagattagaattaaaatgtgtagagtttgaggaaaagttactttatttctatcaagaacttgtgacgaagaaaattatagacgtcatttacaagtgctttattaattattacaagaaaagtaggcaaactgaccaaaaatccaatcagaactccagcactccgtataaacaaagccaaagacaagttccgcactccatcaagtgaacctcaacagctacacattcttttataatccttaatattctatatatacatatatgaaaaaatagaaaacgcgaaaacttgtcattttttttttaggcgtttttataataaactgaaaataaaaagaggctctttaaatgttgacactctactccaatatcaactgtaaaaaatctctttatctgctgacctaacatcaaaatcctcagattaaaagtatgtcctccactaggccagagctaaaattctctgatgtatcagaggagagaaacttctataagaagtatacagggttgccgaagaaaccattaaaaaccattagattagtggataaaggcgactattacacagttataggttcagatgcgatatttgttgcagattcagtctatcatactcaatctgttttaaagaactgtcaattggatcctgtaacggcaaagaacttccatgaaccaactaaatatgttactgtttcgctacaagttcttgccactctgctgaagttatgtttgttggatctaggatataaagttgagatatacgataagggttggaaattaattaaaagtgcatctccagggaacattgagcaagttaatgagctaatgaatatgaacattgattcgagtatcatcattgcaagtttgaaagttcaatggaattcccaagatgggaactgcattattggagttgctttcattgataccactgcatacaaggtgggcatgcttgatattgtcgataatgaagtgtattccaacctagagagtttcttgattcaattgggtgtaaaggaatgtttggtgcaggacttaacatcaaattcaaactccaatgctgaaatgcagaaagtaataaatgtaattgatcgctgtgggtgcgtcgttacattattgaaaaactcagaattttctgaaaaagatgtcgaactggatttaaccaagttactgggcgatgatttggcattatcgttaccacaaaaatactctaaactatc

SEQ ID NO: 72 - protein, 609 aa, Saccharomyces cerevisiae
MDNILKASNMEGTSTMTVTSRSSEDSSCISNHEQDTDTHKDGDTSGLENSKISKRKWMKEFFKLSKSPASKSNRSIGSMKSNQSLVSMKSSDDGNSYKNDYSSICGNSLPSAGLSRSNSVKELKLDSTGSQRSKNNVAMLARSSTTSQTTCSSSSSSSSYNSIKGNENDILLQNNNHFRHNKEIPQSKGSSNINTASIMSQYNVDTQATAIMSDMQKQYDSQQMTSPFVNEDLHFDPNGEVSHVIKAIFKEIGYKYDDFSDIPVFQLMQEMYQLVKKNSSARRTKITDYASKLKEKETQLKSQNDKILKLETTNKAYKTKYKEVSLENKKIKEAFKELDNESYNHDEELLKKYKYTRETLDRVNREQQLIIDQNEFLKKNVNELQNEVNATNFKFSLFKEKYAKLADSITELNTSTKKREALGENLTFECNELKEICLKYKKNIENISNTNKNLQNSFKNERKKVLDLRNERNLLKKEILLIECHGSYSLLLVSNILTCYRFLLPSDTIIETESLIKELLNMNNSLSNHVSSSDEPPAEYSKRLELKCVEFEEKLLYFYQELVTKKIIDVIYKCFINYYKKSRQTDQKSNQNSSTPYKQSQRQVPHSIK

SEQ ID NO: 73 - DNA, 4754 bp, Saccharomyces cerevisiae
atttcaaagcagtttgtgcaatttgtccagcagttctgtatttgttcaagaccgattcctgtagaatatttttgtcctttagcaaaatctgagtatcctcgtgggagatagctagagccatgatagttttagcaatattagtcgggtcgggttttttcttaaaagtattttgaataacacgatgctttagctcatctcatctcttctgctgaaatttttctttacttcggtaaaattttttcagaaagaaaaaaaagcttcagaggcatgaccctctccgggtaaaaaaagcttagggttaccggcctgtcatttttagggcataataaatttttgccatctagttgcaactataataatacagtatgaattgcacgaaagagcagtcaatgtaaattcacgaagtgactgacagaatactgacatcagctgatttctcatggagctgtttctctgataacacgttgtttgaacatcgacaagatgaaaatctagaagtatcaaatttcctttaaagggatatataacagattctaaaactgacagaaatatttcgagtgaagaagaagcgttaaatattggatctttccgcagttctactctgatacatttttgaagtaggagagtcatttagaaggcgtattgctcaatagtagaaagcaggcctgtgcacatgaattaattaaaaaatataaaggtagtgattagacgacacatgtccataggtaacctgtcataattttgaacaatttccctttttttctttttttttttttgggtgcggcgatatgtagcttgttaatttacacatcatgtacttttctgcatcaaaatatgaaaggcgatagtagctaaagaaaataccgagaatttcctcgaaaagttgacgacaaaagaaaggcataaaaaagtaatttgaaaatattttaaaactgttttaacccatctagcatccgcgctaaaaaaggaagatacaggatacagcggaaacaacttttaaatgatggaaactcctacagacaatatagtttccccttttcacaattttggtagctcgacacaatatagtggtaccttgtcgagaacgcccaaccaaataatagagctagagaagcccagcactctatctccattgtcaagaggaaaaaaatggacggaaaagttagccaggttccaaagaagtagtgctaaaaagaaaagattctcaccttctcctatttcctcctctacattttcgttctcacccaaatctagggtcacttcttcaaactcttctggcaatgaagacggtaatctaatgaatacaccttctacggtttccactgattatttaccacaacaccctcacagaacatcgtctttgccaagacctaattccaatctctttcacgcaagtaatagtaacctatcccgagcaaatgagcctccaagggccgaaaatttatcagataatataccacccaaggtcgctccatttggctatccaatacaaagaacctctattaaaaaatcctttttgaatgcttcttgtacgttatgtgacgagcctatttctaacagaagaaagggagagaaaattatagagcttgcatgtggccacttaagtcaccaagaatgtcttattatctcttttggcaccacttcaaaggcagacgttcgtgcgctatttcctttttgtaccaaatgtaaaaaagatactaacaaagccgttcaatgcattccagaaaatgatgaactaaaggatattctaatttctgattttttgattcataagattcctgattctgagttatcaatcacacctcagtcccgctttcctccttattcaccactcttgcctccttttggtttatcctatacacctgttgaaagacaaacgatatattctcaagctccaagtctaaacccaaatctcatattggctgcaccccccaaggaaagaaaccaaattccacaaaaaaaatcaaactatacatttttacattcactcctggggcacagaagaattccgtccggagcaaactctatcttagcagacacctctgtagcgttatcagctaatgattctatttctgctgtttccaattcggtaagagcaaaggatgacgaaaccaaaataacgttgccgctgttaaggtcatattttattcaaattcttttgaacaatttccaggaagaattgcaggattggagaatagacggggactatggattactaaggttggtagacaaattgatgatttccaaagatggtcagagatatatacaatgctggtgtttcttatttgaagacgcatttgtaatagcagaagtggataacgatgttgatgttttggaaactagactaaagaatttagaagtatttacacctattgccaacttgagaatgactacactcgaagcttcagtactcaaatgcaccttaaataaacaacattgcgccgatttatcagatctttacattgttcagaatataaattctgacgaaagcacaactgtacagaaatggatatctggtatattgaatcaggattttgtattcaatgaggacaatatcacttccaccctgcctattcttcccattataaagaacttttcaaaagatgttggtaatggtaggtacgagacgagtacctttctaggtttaatcaatcctaacaaagttgttgaagttgcaaatgtgcacgataatgatactgtaatcataaggaggggattcaccttaaattcaggagaatgttctaggcagagtactgttgacagtatacaatctgttctaactacgataagctcaattctttccttaaaacgagaaaaacctgataatttggcaataatcttacagattgactttacgaaattgaaggaagaagacagtttaattgttatttataacagcctaaaagctttaaccattaaatttgcgcgtttgcagttttgtttcgttgatcgaaataattatgttctggactatggatcggtattacacaagatagattcactagattccatctcaaatctcaaatcaaagagttcctcgacacaattttcacctatttggctgaaaaatactctatatcccgaaaatattcatgaacatttgggtattgttgctgtatcaaatagtaatatggaagcaaaaaaatccgtactatttcaagattacagatgctttacaagttttggaagaagaaggcccaatgaattgaagattaaggtgggctatttgaacgttgactacagtgataaaattgatgaactagtcgaggccagctcctggacttttgttttagaaactctttgctacagtttcggtctaagttttgatgaagatgatgacgatgacgaagaggataatgatgattcgaccgataatgaacttgataatagttcaggattactgtcggatgctgaatctacaaccactattcatattgactctccatttgataatgaaaatgctaccgcaaatatggtgaatgacagaaaccttctcactgagggtgaacatagcaatatagaaaacttagaaactgtcgcttcttcagtacagccagctctgattcctaatattagattttcacttcattctgaggaggagggtactaatgaaaatgaaaatgaaaatgatatgccagtattattacttagtgatatggataaaggaatcgatggcataaccagacgcagttcattctcgagtcttatagagagcggtaataacaactgtcccctccatatggattatatatagagtatacactaaattttatgcaataataaaaaggaagcatcccgccaaacgtttcttaactatatattgttacatagcttgattccgtgaatttgaagtggacgcagttcttcttagtctttcaagttcatagtaaatagacattacccaaagatctctttcctgtcttgatcttgccatgaaaaccattgacttgccgctcacacctaactttttagtgaaatggatcttatctgtgttacttggaacattagtgttattcaagtcagcttccggagcagaaggtgggtcaatattattatcttgtctaccataatcttgcgtatattgcttttcattccctttcttctgtaagcgattgctagaaagggcacgccttgttccaaaccaaagcgtaaagcatcgcgaactctcgtcttctacagatcgccatccgtccccataaactcgtgggagagcgtgggatccatagtttatttcgtcaaaagtacgatctctctgcagaaggtctagttctgttgtggtcccagagtataggtagcaatcgtcaatcggaatggttacataatgagcatactccaaaacttccttagcaaaacctgtggttgatctatgaaagcagtggaacagtacaataaaacctgatatcaaaacgacgtagtacttcgagaaaacagaatgcttgtgcggcttttgatataaaggtcccttttgaattaacggcctacttaatgatattccatttgcattaaaggtttgctcatctgcacgcccatgttctacgatccagcgcaatgtattctcaccaatttttgtttcctcttctccatttagcatcaaaagacctgcatttgaacgccttatttttaaaagcctctccgtatcttccctttgcttgtttttccaataggatatcatttgtttcagctttatgacccactcttcagcaactgttgctgatgtagcaagcagcttcaagaggagtccatttgaggtttct

SEQ ID NO: 74 - protein, 917 aa, Saccharomyces cerevisiae
MMETPTDNIVSPFHNFGSSTQYSGTLSRTPNQIIELEKPSTLSPLSRGKKWTEKLARFQRSSAKKKRFSPSPISSSTFSFSPKSRVTSSNSSGNEDGNLMNTPSTVSTDYLPQHPHRTSSLPRPNSNLFHASNSNLSRANEPPRAENLSDNIPPKVAPFGYPIQRTSIKKSFLNASCTLCDEPISNRRKGEKIIELACGHLSHQECLIISFGTTSKADVRALFPFCTKCKKDTNKAVQCIPENDELKDILISDFLIHKIPDSELSITPQSRFPPYSPLLPPFGLSYTPVERQTIYSQAPSLNPNLILAAPPKERNQIPQKKSNYTFLHSLLGHRRIPSGANSILADTSVALSANDSISAVSNSVRAKDDETKITLPLLRSYFIQILLNNFQEELQDWRIDGDYGLLRLVDKLMISKDGQRYIQCWCFLFEDAFVIAEVDNDVDVLETRLKNLEVFTPIANLRMTTLEASVLKCTLNKQHCADLSDLYIVQNINSDESTTVQKWISGILNQDFVFNEDNITSTLPILPIIKNFSKDVGNGRYETSTFLGLINPNKVVEVANVHDNDTVIIRRGFTLNSGECSRQSTVDSIQSVLTTISSILSLKREKPDNLAIILQIDFTKLKEEDSLIVIYNSLKALTIKFARLQFCFVDRNNYVLDYGSVLHKIDSLDSISNLKSKSSSTQFSPIWLKNTLYPENIHEHLGIVAVSNSNMEAKKSVLFQDYRCFTSFGRRRPNELKIKVGYLNVDYSDKIDELVEASSWTFVLETLCYSFGLSFDEDDDDDEEDNDDSTDNELDNSSGLLSDAESTTTIHIDSPFDNENATANMVNDRNLLTEGEHSNIENLETVASSVQPALIPNIRFSLHSEEEGTNENENENDMPVLLLSDMDKGIDGITRRSSFSSLIESGNNNCPLHMDYI

SEQ ID NO: 75 - DNA, 3272 bp, Saccharomyces cerevisiae
acagaaatatttgaaatatatttcctcaaagagtacactagatccattcatattttaggcttcctatggaaaccgttttttcaaggataaaccccgccatatgttctttgcgaagtcttttgcagttaaaactaattacaactctgttatttactgacacctgcgttaaaattttatcacaatatgtcatccgctgagagagatgtactatttataattacttaagagcgactacttcatttaccattagcgagcagaagaacagcttacttgtcgatgttcttctctggctaaatgaaatgtcaattattgagattgagatgggtatgtatgatcggattttgatatcagccgatgagacgaagattcaatagcttcaaccgtccctgcggggggtacttaccttttgtaaccagtaccctgtgcaaattctcggcgtgtactacctcttttgggaccacaaccctttgtacgcactttcgtcagatgcaaatttttacacgcgttgaaaaatgtttcaggaagagatactgcgtaaaaaaaagacacatgtgttacgcaggaaaaagtttgtgaggctttttgccttaacagattgacttgtagccctgttaggtttacccaacagttgtttttctgtgtgtcgaaaattttttcagattgttttcaactgacacttgcctgtttcatattagttgtaacttaaactttcaaacataaaacttttttggaagtccatccttcacatgacttgaatcccttcaatatcgaaacagtatcctcaaaatctcttatcacttttctaattgttttcttcccctttttgtagtaactcgctgtaaagcacattttattcataatctcctttgtgccagaactcaaggtcaataggccagaattattggaaggaaagagggaagaaaatacgatattgctagttcattaagtcaaggaagaaaatactcaaaaaactgtacagctcaatcaggtacacattacgatggcagcacatcagatggactcgataacgtattctaataatgtcacccaacagtatatacaaccacaaagtctacaggatatctctgcagtggaggatgaaattcaaaataaaatagaggccgccagacaagagagtaaacagcttcatgctcaaataaataaagcaaaacacaagatacaagatgcaagcttattccagatggccaacaaagttacttcgttgaccaaaaataagatcaacttaaagccaaatatcgtgttgaaaggccataataataaaatctcagattttcggtggagtcgagattcaaaacgtattttgagtgcaagtcaagatggctttatgcttatatgggacagtgcttcaggtttaaaacagaacgctattccattagattctcaatgggttctttcctgcgctatttcgccatcgagtactttggtagcaagcgcaggattaaacaataactgtaccatttatagagtttcgaaagaaaacagagtagcgcaaaacgttgcgtcaattttcaaaggacatacttgctatatttctgacattgaatttacagataacgcacatatattgacagcaagtggggatatgacatgtgccttgtgggatataccgaaagcaaagagggtgagagaatattctgaccatttaggtgatgttttggcattagctattcctgaagagccaaactcagaaaattcttcgaacacattcgctagctgtggatcagacgggtatacttacatatgggatagcagatctccgtccgctgtacaaagcttttacgttaacgatagtgatattaatgcacttcgttttttcaaagacgggatgtcgattgttgcaggaagtgacaatggtgcgataaatatgtatgatttaaggtcggactgttctattgctactttttctctttttcgaggttatgaagaacgtacccctacccctacttatatggcagctaacatggagtacaataccgcgcaatcgccacaaactttaaaatcaacaagctcaagctatctagacaaccaaggcgttgtttctttagattttagtgcatctggaagattgatgtactcatgctatacagacattggttgtgttgtgtgggatgtattaaaaggagagattgttggaaaattagaaggtcatggtggcagagtcactggtgtgcgctcgagtccagatgggttagctgtatgtacaggttcatgggactcaaccatgaaaatatggtctccaggttatcaatagcttcgaattggaaatactgtgagcagtaattatcaatggatgctattatataaatatacatacctacacccatcccatatttacatagaataacaacagtaacattagttctgtggaagcgcaaaaacgtcctttaataaagtaagtcaaaacattcaacaatgaaaattcaaagcattgtcatttgcttcctttttctctttggataaacgaaacaaaaacgaacaaaagtgtcatgcactcaaaaattcttttcaatcgttttggaaacagtattattcactgacttatttgaccaacttgctagaatcatctatgttttcaggcattgtttaatttcatgatggctgtccctactttagcttgttatgagccttcactggctcgtccttatgtattgcgtctgacccaaaatttgtcctttcttgtttagtggaatttttgttcggtaatttcaaaaatgcctgaattttcattaacaaatcatctggtagttgtgttataaacataaaaaactgctcccttctgggatgattttcaattgctctctgtactgcaggatcattcaatatcatctgaaccacgtccgtcatcatatcctcatctataagcgcaaggcttttaatccagggcaaatcggctatacgaagagacatttcttcctccggagacactactttccacgggagatcaaaatatttagatagttcactattgagatgtgagaattcatgaggcacatcaacggtatagtcaactgcatatgcatcatcttcaaacgttaagtcatgttcaatgctaaactttccagcgttacctataaaaaagcattctatttttaagttaaactctccccaaccggtttccttgataaaaaatggcagcgagttcagtcgtcttttgggctgtttgaagctagagtgcaaatggtagatgcatttagagaggatggtaggctccacttcctttcctgttgcatctaacatgaggagttccatct

SEQ ID NO: 76 - protein, 423 aa, Saccharomyces cerevisiae; identical to SEQ ID NO: 20

SEQ ID NO: 77 - DNA, 2333 bp, Saccharomyces cerevisiae
atattatatatatatatagggtcgtatatatatcgtgcgtcttcttccttctctaagggtaaaattccttgtatttgttataatagtagtaactgccgagcccacccaaagctgtcaaaacgacagggacaggtttagtgaacctggaaggcatgcctcttatgacaccagcaccaagtagtaaggtcgatgcacccaatgccatttcgagcccaccatctctattcatatgtagcaagtaaccggcaatcccatatacactaccgaatactaagccagatactagagatggaatggagcccttacggtagtatcccataaggccaccggctgtagtcaaaagactcaatgtatatgctggatgttccatagtgtgatctgatgttcctttctctcaaacttcgtttctgtcttgtctcccgctgttacctaataacttcatgtgatctgctcccccttctcgttaaataccaccttttcatcaaccccgtagggcgcgacacgtctaaaatattaacctctgaatacttattgggtcaaaatgaatgttgataactttcctttacaaaaaaaaaactaatagagtatatgcatttcggtagtgaaatattcgttaatgctaatatgctcagtagtgatcctagattaccagttttactgcagccatcgtacaattttggaacgagtataaagagagaaattaaaaacgacaagaaatattcgtactagcttctcttccggcttgatgacagtcttaatatcatctgcaactcttgaaatcttgctttatggtcaaaatttacgtacgcttttcattatataatatgatttgtcaatgtgatgagtgaatgtctccctgttacccggttttcatgttgatttttgtttcaggctctaaatgtttgatgcaatatttaacaaggagaacagaaatgttttgtgacagcacctgtcaattttaggatagtagcaatcgcaaacgttctcaataattctaagaatgacatcagttcaaaactctccacgcttacaacaacctcaggaacagcaacagcaacagcaacagctttccttaaagataaaacaattgaagttaaaaagaatcaacgaacttaacaataaactgaggaaagaactcagccgtgaaagaattactgcttcaaatgcatgtcttacaataataaactatacctcgaatacaaaagattatacattaccagaactatggggctaccccgtagcaggatcaaatcattttatagagggtttgaaaaatgctcaaaaaaatagccaaatgtcaaactcaaatagtgtttgttgtacgcttatgtaatgatagtaatagaatccaaaaaaaaaaaaaatatacatgctttttcatatcctctctcaccctatctttttttttcttctaattttggctccgttcatatcttattcaaaattaattcagcggtaatcttatctttattgttagacttcgcagaaatttcatttagcttcgatgcagatagtttgatcaagtcattttgtttattacgtcccagttcgcgagaaatgatgttaaccaatgcccacccttttaggtatagttcgctaagttcaacgctcctcaaagcattctttaatgccttttccaagagctcggtcttggtttgtttcttgctacgtagagcctcataatacagagtctcacttagcctaccaaaacaagcgtaattgaatggtgtaatacataggacctgttccaaacaataacgggctttttcaaattggcccatttcgaaataaatctcgctggcataccaccacaattctgcatcaagcgggaatttatctgtaagagctaccacttctttaagaacactttcttggctcaagttcttggaagttgtcttgatagctatcaatttctttgcaatagagacataagtaacgaagtccgtttcatactccagatcatcattcaacaaattttccagatattcaatagcgcctttatcatttccgtttatctgcaataaagtggctttcatgattaccattttatacgaattttcaccaagacgatctcttaatgtattataaacaacttgcgcatcaacgtcttggtttcggtacaccaaaacatagaaaagcatttccatcaagaagaaatagtttccttctgttagtccagagtctccacttttcatgtaaattttcatttcattttctagttgcagtaattgttctggattaaattgagtatacgctttggtattcataattgtcaaaagcttttctctaaccaaatccttcaacattgttttatctactgctttgtataattt

SEQ ID NO: 78 - protein, 110 aa, Saccharomyces cerevisiae; identical to SEQ ID NO: 22

SEQ ID NO: 79 - DNA, 4067 bp, Saccharomyces cerevisiae
cctctgatgcgcaattcatggaattgtactcttgccagaaattaagtgattcgatagtcactccattggacgtagaaaactctttattacagaagttgtctgcaaagagtttgaagatatccctaacaaagcggaacaagttccagttccgccatcgagaaatcgtcaagagcatgcaaggagtttatcacaaccatcacaactccgttaatcaagagcaggtcttgaacgttttgttcgagaatagcaagcaagttcttttaggtttaaaagatatgttgaaaagcgacgggcaacccacttacttacatctgaaaattgcaagttacattctttgtataacgaacgttaaggaacccataaagctaaagacatttgttgaaaacgaatgtaaagaattggtccagtttgcacaagacaccctgaagaacttcgttcagtaatcactttcaagctgtagtatgtaaacgatatagatgaagttttcgtgtgtataaatatatgaactctagagtgttgcataatttgaaacacagcatttcttttcggagagctcgtttcaaaatgaaacaaacgccgttgtccgttttcgtctcaatagaaaaagtgaaacagataaaaattgttttaaaagaaacgaatttgcaacatcttaagatatatcaaaactaatacaaaacagcctaaaaaagattgaacaactcttcgcggtcaggtctcgacaccataaatcgaagtactcgtacgctagttttctcgcacatagtaccactacgttccttttacaattagattacttctttttagttgacttttttgagacgttcgtgccattcataaaataggaaaagataacaggtaagcactgaagacttgttttataagtgtcccaagcgagacctagagtggatattgatatttctcaaacaagactcgtcgaagaaaacacacttttatagcggaaccgctttctttatttgaattgtcttgttcaccaaggatgaaagtccaaataaccaatagtagaacagaggaaatcttaaaagttcaagctaataatgaaaacgatgaagtcagtaaagctactccgggcgaagttgaagaatcgctaaggttaatcggcgatctaaaattctttttagccacagcgccggtaaattggcaagaaaaccaaattataaggcgatactatctgaatagtggacaaggctttgtctcttgtgtattttggaacaatctatactatattacaggtactgatattgtcaaatgttgtctttacagaatgcaaaagtttgggagagaagtagttcaaaagaaaaaatttgaagagggtattttttcagatttaagaaatctcaaatgtggtatagatgcaactttagaacaaccaaagtccgaatttttgtcgtttctattcagaaatatgtgtctgaaaacccaaaaaaagcagaaagtatttttttggttcagtgtagcacatgataagttgtttgcggatgcgttggaaagagatttaaaaagagaaagtttgaatcagccttcaacgactaagcccgttaatgagcccgccttatctttttcatatgattcctcatctgataagcctctctacgatcagttacttcaacatttagattctagaagaccatctagtacaacaaaatcagataattcgcctccaaaattagaaagcgagaattttaaggataatgagttggtaacagtaactaatcagccgcttttaggcgttggcctcatggatgacgatgcgccagaatccccctctcaaattaatgattttattcctcagaaattgattatagaacccaatactctcgaattgaatggtctcacagaagaaacgcctcatgacttacccaagaataccgctaagggcagagacgaagaagattttcctctcgactattttcctgtatctgttgaataccctacggaggaaaatgcgtttgatccgttccctccacaggcttttacgccagctgccccttccatgcctatttcctatgataacgtgaatgaaagggattctatgcccgttaattctcttcttaatagatacccctatcagttatcagtggcacccactttcccagtgccaccatcatcatcgaggcaacattttatgacaaatcgggatttttattcatctaacaataacaaggaaaaattggtatctcctagcgaccctaccagctacatgaagtatgacgaaccagttatggattttgatgaatctcggccaaatgaaaactgtacaaatgcaaaatctcacaactctggccagcaaactaaacaacaccaattatattctaacaacttccagcaatcttacccaaacggaatggttccaggatactacccaaaaatgccgtataatcccatggggggggatcctctactcgatcaagccttttatggcgcggacgattttttctttccaccagaaggatgtgataacaatatgctgtatccacaaactgcaacttcatggaatgttttgccccctcaagctatgcaaccagctccaacctatgttgggagaccatacacaccgaattatagatcgacaccaggttccgcgatgttcccatacatgcaaagttcaaattccatgcagtggaacactgctgtttcaccttatagttcgagagcaccatctacaactgctaaaaactatcctcctagcacattttattctcaaaatataaatcaatacccacggcgaagaactgtgggaatgaagtcttcacaaggaaatgttccaacaggtaataaacaatctgtgggcaagtctgcaaaaatttcaaagcctctacatattaagacaagtgcttatcagaagcaatacaaaatcaacttggaaacgaaagccaggccaagtgctggtgacgaagattctgctcatcctgataagaacaaagaaatttcgatgcctactccggattccaatactttggtggtccagtcagaagaaggtggagctcattcacttgaggtagataccaatcgaaggtccgataaaaaccttccagatgcaacctgatataatataatttttgaatttatgatacaagaattaaaaatgcgggccagaatttaatattaaacaatactcagaagaaaacaacaaggacaatctgtttttataaataaaacaatcttatacaagactagagcaaacaaaaagcaagaaaaaaaggtaataaatgtaacaaatctattaacgttagaaaataacaaaaaaaaaaaaagaaaaagataatataatataatacctttatatatgtgatttatctagcgtcacagtatgtaatataaatatcaatgagtttcttaacatgacctccaaaactacatgatcgcttagtattacaatatgtgtttatccactattttgataccaacgtagtattgccttttatttttcagaatggcaaaggccatcggaaaatttttccaccagaaaaagcgagattcctaattataaggtgaaggcatcgatgttcataatagttaaaagttgtaatcaaaaaagaaaaaggtgcagagataaacaaagttaataaatgacaaaatcaagaaagcagaagcaaaaaaagcaggattttttgagaaaaaagttaaaagttggtaagccaaaggaaaaagcaaggaatgctaccgatacatctttcgtttccaagactatttctattagaaatcaacatttagaccaaaatccacatgatttaacaaaacggctaacgctcttaaagcatcataacatcaatgtgagaaaggaaacattaacaacattccaaaagtcaataccgtctataataaaatctcgacttatgacaccattacttactcaaagtataccgttgatttgcgatgaatcgcagcaagtacgtcagggacttattgatctcgtagatgaaataggtagtcacgatgcggagattttaaaattgcactgcaacatttttgtcttatacattaacatggcaatgacacatattgttacacaaattcaagcagattctactaaatttctctctcat

SEQ ID NO: 80 - protein, 688 aa, Saccharomyces cerevisiae; identical to SEQ ID NO: 24

SEQ ID NO: 81 - DNA, 3548 bp, Saccharomyces cerevisiae
accagtggtcaccatacatgaaataccacagtgttttcccaatgtacggacgacttgggaagtttgcagagctaactctcttgtgggaaccatgatcaaagcctgaattttattcaactttggtttgactttctctaacgtaggaataacaaatgcggctgtcttacctgtaccattctttgctctggccaatatgtctctaccagttattgctaccggaatagcctcttcttgaataggggatggtttttcaaaaccggcttcaaaaatacccattaacagctctcttttcaaataaaaatcttcaaaagtattaccctttgtatttaagacatcgtctgtctgtggtctggtatccttcttgggaatattcaatgcagttttccagtcccgatcgagatccgtattactgttattattagtgttgaagttattattgatggaacccattactactattttctttcttgtcgtattttaggcctgggataagttattatgcgaatggcgatgcggttatgaagaaataaaagggctaaaagtaagaattttctgcgtctatctttctattaggaataaaatatgactatatttactattattgttgttttgtcgtacaatcctttatgaatgaaaatattaagcttgtggtcttaaaagaatgtggatgaaacaaaactgaatccaatgatgagaaataaatgtacaatcagataataaacacttttattgatgattgtcttttcttgcaaaccccaatgttacaatcgcccattagttctaagattgtgttgtcctttttcttacgaaatttttttccctcccttttttgatcactgtcctcgttataagtgattcgtggggtaacggcgatatcatactattattggcccatctgatggattagaagacctacaggttaatgtgaagcgacactaatgataagaaaactgcatcggatcatatctgtttttgcagcgtggtatattggttgttggtcatgtttcaacgaaagactttacagagaaggaacttgaaagggctcaatcttaacctgcacccagatgtgggcaataatggccaattgcaggaaaagacagagactcaccagggacaatctcgaatagaaggccacgtgatgtctaacattaatgcaatacagaataatagcaacctgtttttgcgaagaggcataaaaaaaaaactgacgttggatgcgtttggtgatgaccaagctatatcgaaaccaaacactgtggtaatacagcaaccgcaaaatgaacctgttttagttctgtcttctctatcacaatccccgtgtgtaacatcatcatcatctttgtccacgccatgcattatagatgcgtacagtaataatttcggattatcgccatcatccacgaattctactccctctacgattcagggattgtccaatattgcaacgccagttgaaaacgaacattcgatatcactaccacctttggaggaaagcctatcgccagccgcagcagatctgaaagatacgttgtcgggaacttcaaatggtaattatatacaactccgggacttggttcagttggggaaaattggtgctggaaattctggaactgtggtgaaggcactacatgttcctgattccaaaatagttgccaaaaaaaccattcctgtggaacagaataacagtacaatcatcaaccaattagttagggaattatctatcgtcaaaaacgttaagccccatgaaaacattatcaccttctatggagcttattataaccagcatataaataatgaaatcataattttaatggaatactctgattgtggttctttagataaaatactgtccgtttataaaaggtttgttcaaagagggactgtttcgagtaagaaaacttggttcaacgaattaacaatatcaaaaatagcgtacggcgtactaaatggcttggatcatttgtaccgacaatataagataattcatcgtgatatcaagccttccaatgttctgattaatagtaaggggcagattaagttatgtgattttggagtttccaaaaaactaataaattctatcgctgatacatttgttggaacgtccacttatatgtcaccagagaggatacaaggaaacgtttattctatcaaaggggacgtttggtcattgggcttaatgatcatcgagctggtaactggagagtttcccctaggtgggcataacgatacacctgatggcatattggatttgctgcaacgtattgtcaacgagccttcaccaagattacccaaagaccgtatctattccaaggaaatgacagattttgtcaataggtgttgtattaagaatgaaagggaaaggtcatcgattcatgaattgctacatcatgatcttataatgaaatacgtatcaccgtctaaagatgataaatttagacattggtgtagaaaaataaaatctaaaataaaggaagacaagagaattaaaagagaagccttggaccgtgccaagttagaaaagaaacaatcggaaagatcaacccattgaatgcatgcgataacattagttaggaacatattgcactttttttcacatccctttctcaaaactatattcatatatatatagactctcctgattatgtaaatcaaaaccaattttctaatgtaacaatatttttaaaaataatcatcaaagtagcactttatgtacagaaaatttcacgattgagagaagcttgcgaataatactagttagcctgtgtttcaccatcgttacttaatttcttatagttcttatattctttatttttatgccacaaccaaccttcggttcctctaacgaaaccgaaggcgattaataacccaccgaagctacgtaaagttactttccaccattgtgggtttcttttttcaaattcagtcagagaaatgcctcttttgccttcttgtttaccatacttgaatggtttcccagatgccaagtatgagccaaatccaacagaaaacatagtgctcatgacttgacaaggaacgcaatccatagtctcttctttttccagctccctttgtggtggagggttgaacactgccaaaatattactcattatttttcaccgcttgctgtttctctctaagcggtgttttgtttcctacttggtggcacacaatgactgtactcgctttatatgctcgtaccttttttcaaaagcccatcgttaatttttcacccgaggaccccatattacgcgttttttgttaatgttcaatttccgacatgttacaattataataacgccaaaagaggtaaatgtatatttgaacaattgttaaagagaagataaaaaccctttaatcttgcatttgtcgtcaatagtacacaataggcgatctattttagtacggcaattaaaagaaagctgcttttcagtcaagaatgccggaattaacagaatttcagaaaaaacgtttagagaacatcaaaaggaataacgatttattgaaaaaactccatttgtctggagtagcatctcaaatcaagcacgagg

SEQ ID NO: 82 - protein, 515 aa, Saccharomyces cerevisiae
MFQRKTLQRRNLKGLNLNLHPDVGNNGQLQEKTETHQGQSRIEGHVMSNINAIQNNSNLFLRRGIKKKLTLDAFGDDQAISKPNTVVIQQPQNEPVLVLSSLSQSPCVTSSSSLSTPCIIDAYSNNFGLSPSSTNSTPSTIQGLSNIATPVENEHSISLPPLEESLSPAAADLKDTLSGTSNGNYIQLRDLVQLGKIGAGNSGTVVKALHVPDSKIVAKKTIPVEQNNSTIINQLVRELSIVKNVKPHENIITFYGAYYNQHINNEIIILMEYSDCGSLDKILSVYKRFVQRGTVSSKKTWFNELTISKIAYGVLNGLDHLYRQYKIIHRDIKPSNVLINSKGQIKLCDFGVSKKLINSIADTFVGTSTYMSPERIQGNVYSIKGDVWSLGLMIIELVTGEFPLGGHNDTPDGILDLLQRIVNEPSPRLPKDRIYSKEMTDFVNRCCIKNERERSSIHELLHHDLIMKYVSPSKDDKFRHWCRKIKSKIKEDKRIKREALDRAKLEKKQSERSTH

SEQ ID NO: 83 - DNA, 4154 bp, Saccharomyces cerevisiae
taaaacatccttcataaaaacaaccaatatgaaaacattcgtgatagcctatatttacaactagcttatcgtcatttgagaatccctctagacctttattttggaaccatagattatcaacgtgtgatatcgggagtgcaaggtcgaaaccgatgtgctcttcaactcttggcgcctgtaggaagtaaaatagggcaatcactacaaaaactaccaagtataataggtacctttgatacagcctcggtaaccggatcatgttaagatttttaaccacggtgctggtcttcgataattaagtataaaacttgtatcagaggtatctgcgatctaaaaagattaatttttgaaaaagatcaacactaaaccatttgaaattcaaaaagcacctaaggcaaaatataaatctaaatatacgtaaaatggaaacactttctgcgcagctttatacaagttagccttctagcttatgaaatagaaatgaaatataactgagcaagtcctatatacaatactattaatgatcttcttgtccatgagactgttcatggtgccttttagagacttcttcatcacttagctgaggcctgtggccacccgttctcaataaaccaccggcagtatcctcaactggaaatcttgcactgggccttacgcaatggggcttgcgtaactgttcaaaatccatgattttagttttccctcccccttttaaagtaatctttggattctcgcccaatttttgctccacttcttttatattttgggtgcgttctttactattactattattattattattactaactgccattatagtttctttatgctgtcctcaccatgcctttcgttatcaggctagcattaaaagccttttaaggtgtaaagctttcgccgcgatggctttaaacagtagaaaatattcatatttacacacatgcataaagagagaccacttaataaagctagtatgataagatcaccggtagacgaaatatacatggaacagacacaaacagcagagggcactgacttactaattggtgacgaaaagaccaacgatttaccttttgtgcagttatttctggaggaaataggatgcactcaatacctggatagctttattcagtgcaaccttgtcacagaagaagaaattaagtatctcgacaaggatattctcattgctttgggtgtaaacaaaataggagacagactcaaaattttaaggaagtcaaaatcgttccagagagataaacggattgaacaggtgaatagattgaagaacctgatggaaaaagtaagctctctatccactgctacgctatcgatgaattcagaattgattcctgaaaagcactgtgttatatttatcttaaacgatggttccgctaagaaagttaatgtaaatggttgctttaatgcagattctattaagaaaaggctaatcagaagattgccacatgaattattagccacaaactccaatggagaagtaactaaaatggttcaagattatgatgtgtttgtcttagattataccaagaacgtactgcatttgctatatgacgtggaattagtcactatttgccacgcaaatgatcgtgttgagaaaaataggctaatttttgtttccaaagaccaaacaccaagtgataaagctatatccacatccaaaaaactatatctaagaacgttgagtgcattgagccaggttgggccatcctcgtcaaatttgttggcacagaacaaggggatttcgcataacaatgctgaagggaaactccggatcgacaacacagaaaaggacagaattagacagatttttaatcagaggcctcctagcgaatttatttctaccaatttggccggatattttcctcatacagacatgaagcggttgcaaaagacgatgagagagtcatttcgccattcagcaaggctaagcattgctcaaagaagacctttaagtgcagaatcaaataatatcggtgacatactattgaaacactcaaacgctgttgatatggccctgttacaaggattagatcagacaagattaagcagtaaacttgacacaactaaaattccgaagcttgcccataaaaggccagaagataatgatgccatatctaaccagttagaactattaagtgtagagtctggtgaagaagaagatcacgatttctttggggaggacagtgacattgtttcattaccgacgaagattgccacgcccaagaattggttaaaaggtgcttgcattggatcaggcagttttgggagtgtttacttgggcatgaatgcccacactggtgaactaatggcagtaaagcaagtggagataaaaaataataacattggtgtttccacagacaacaataaacaagccaattctgatgagaataatgagcaggaggaacaacaagagaaaatagaagatgttggggcggtaagtcatccaaaaaccaatcaaaatattcacagaaagatggttgatgctttacagcatgaaatgaatttattgaaggagttacatcatgagaacattgttacttattatggtgcttctcaagaaggcggaaatttaaatatttttcttgaatacgttcctgggggttcggtttcctccatgctgaataattacggaccatttgaggaatcactgattactaatttcactaggcaaatactgattggggttgcgtatttgcataagaagaacattattcacagagatatcaagggtgcaaatattttgattgatatcaaaggttgcgtaaaaattactgattttggtatttcaaaaaaattatcacctttgaataaaaaacaaaataagagagcttctttgcaaggttccgtattctggatgtcaccagaggtggtcaaacagagcgctactactgctaaagcggatatatggtctacaggatgtgttgtcattgaaatgtttaccggtaagcatcctttcccagatttttctcaaatgcaagcgatcttcaaaataggcacaaacacgacccccgagataccttcctgggctacgtcagaaggaaagaatttcttaagaaaggcatttgagttggattatcaatacaggcctagtgcccttgaattgctgcagcatccatggctggatgcgcacataatttgaaaaagggctacttattaattctttttatggcactaaagtgctctggccgattttttatcaaataatacatatatatcatatttagtgacatttattgaatatatctgctatttaccggtttttttttttcaattacgctgattaagtaatcataaatcacaattgtgaaaaaaagaccaaactagatgacggtatttgattctcatacccctggaataaaatcaagtaagataattctgataaaaaaatccgactgcacagatggaagcacgaagaaacaggcctttctttgcgaggtgatatcaaaccattgatatcttctcaataacctgctctaggaaaaggaggtagatagacaaaagcaaggaaataatccatagagtttcattcacatgaataatctgttaccaatttttctcataagataaagccatctatcaaaaatgatattgaaatatttgaaaaatgcttgtttttatggggaccacaattcgcctgtacctctagaagcgtaaactgttttattgaagttagtcctgataatttctctaccgttttcgctttcttccttagtgccattttttagcatcatattattgaatttttcactttctctaaatgatttatcattcatgtccttggacaagattgaatctacatcaacaattgaacaggaaggaatattgcattgcatggccatttcccggatttgaggatcttcactaattaaaaaccaatgtagcccctcatttccttctaggtagcatttgtaaatacaacttttcaacaaattctttaatctcttaggcaattttgcaatattcatctttccagaactatcattatgttccattacatctgaccataaaataatgtctaaaacttcgggaaattcgataaaaactttcaaattagcaaatttagaatcatctaatctatcgataaacttcaaggattctcgagctgcaaaacttttacgcctttgttgaaggaaatccaa

SEQ ID NO: 84 - protein, 717 aa, Saccharomyces cerevisiae
MEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVSTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQSATTAKADIWSTGCVVIEMFTGKHPFPDFSQMQAIFKIGTNTTPEIPSWATSEGKNFLRKAFELDYQYRPSALELLQHPWLDAHII

SEQ ID NO: 85 - DNA, 3083 bp, Saccharomyces cerevisiae
tgcactcaaaaaccttcttagttacaggaaaaggtaacgatacgataagaaaagcctttgaactgcctatcctgcaccctaacacagatctaacccactattcgggtaaggaagtgtcatgcatgtctgcaaagggactagaagaaagttacaggattacataagcaaaaaaccggaattacagacacaccattttttatcctgcggccccatttccgtcttcgaggggaaggatcaaaggcgcttagcccaatcttgatgattcaccgtggaagaaaggaattgcagaacccccagccacgtaacacagccaattagttttctatatcgggaaacgtgattgattgcgcatttttggctgcatcataatacatcgatgagatctagagcaccctttgatggtttaagtccggtttaaagttagtagatcaatgatttcgtagtgcattttaaagggagcgcttatccatgggtgattgcgtttacaacgttttgtgtgtactcataatagccaatctaaaattaaacaacaacaacaacgcacaattaatatgtatcagccccaatacctttttctcttactgtaatttactactaaattggggccggacgtttttgatcttgttccttgcccgttgtttaccttgtatattacttttcctcttttatgtatttaaggtaaattaattatcttttgatcttaatatttttctcaaaatgcttcccttgtagttcggtatttttgcttcttcagatatttaaactaccgtataccataactgtttcgtgaagtagatacaaacatcgactatcctattacgatttattttacattatcatattataaatcgaccagtagtattgttaaagattaaaagcataatatactactgtcattagtcacctacagagaaacaaattcctactggcacccattactggtgaaaaaggaaaaaaataataaaagaaaagcttttctattcctctccccacaaacaaaatgcaagcggatatgcatggaaaacttcacgctgccttagaagatggtttcttcctctttccttttgaacagcaacaacaacctaacatttattatgacacaaccaccgatcaagaagaccgtccttgtttttcttttggatctacaatttcccctagaagttggcattttgaaaagtctgacaaaattgcctcatctcagctgcagaacttggttcatacacaaccaattcatttaattaatcctcaaatattgttcaatgaagagtttctgaatttggaaaatattgattctcagcctatttccaaggaaacgaaaactacgaaggactgcacaatggcaactggtcctgaaagaggaaaaaagagctctgaaagtaccagatcctcttcattatcatctcttttttctaatgatgaatccgcatctacgttccactcatcattcaataaccatgataactttcaaaagagcaacagaaatggagatgatatcgatattagtgacacaataaaatatgaaactaatacaaatgcacaaaaagatatcaaaatattccaagaaaattttgaattcaatgaattcccatacacacaagacttctacccatataccaccaattatacctattcaaaacccacaaatattcatgaatcaataaattcaaaaaacacggattcatactcccaatatcaagatcagtttccaccacatactgataacatacattcctttaataatcgtcactatagcaaccataaaagcactaattgtaattactataataataccagcaataataacaacgcctccgataatgtatatgaggcagatccatttatagatgaacctcaggtgccctcctactattacccattagaaattgccttcgacgttgaaaaatcaccaccgccatcactacaaaaattaaattcaaaagagttagaattcctaaaaaagttgaactccaaactgtcaagatatgctgcggcttactccttcagcagttctaatgatcaagattattatgacaaggtcaggtttcaagaaatatcctacaagtttagtaaaacctattcttaattctcgaaaagtactacaatcttcccccttccctcaaaatatatccattcacactcatttctttatttccattgtctcactcaaattgctaagaatttgtgtatttgcatatatatatattatatataggtatatatatgtattcaatgtctcaagctccatgacataataccgtagcgttattagccttatcgtatgtcgcgatgggaaaggagattcgttttaatcttgaaaaaccttcgtagcgaataatgcgacataaatcttgagagagtacatcaccaaattcactttgttaaaccgcaccatcgtgctttgcattcttattccttttgcctacactaaaattattagcatttctctaaatgagctccagtgaagacgaagacgacaagttcttgtatggttccgactccgaattagcactaccttcatctaaacgatcaagagatgatgaagcagacgcaggtgcgtccagtaatcctgatatagttaaaaggcaaaaattcgactctcccgtggaagaaactccagctactgccagagatgatcgttctgatgaagatatctactctgactcctcagatgacgatagtgattctgacctagaggttatcataagtctgggtcctgaccctactaggttagatgcaaaactactcgattcttattctaccgcagcgacatcttcaagcaaagacgtaattagcgtagctacagatgtatccaataccatcacaaagacatcagatgaaagactaataacagaaggagaagcaaatcaaggtgtaacggcaacgaccgtaaaagctacagagagcgatggaaatgtaccgaaagcaatgactggttctatagacctggataaagagggaatctttgatagtgttggcataacgacaatagatcctgaagtattaaaggagaaaccctggaggcaaccgggggccaacttaagtgattatttcaattacggttttaacgaatttacctggatgga

SEQ ID NO: 86 - protein, 360 aa, Saccharomyces cerevisiae; identical to SEQ ID NO: 2

SEQ ID NO: 87 - DNA, 3938 bp, Saccharomyces cerevisiae
cccaatgccccacttttctcgaggagttgaaacaagcgggacaactgctacgtcataaaaatgggagtaccaagggaggagccataagccgggtaaaatttggcgctgtttttcttaatctaaaaatagttcaacaaaaaaatttgggctccgcccatccagaccaaagcaatcttcggccttaacaagccaaagggaacgaaacccagactctaccatgcatttcgaacatcttgtagctaactacactggtaacccagatacctattctctcagtagctgtttcaccaagactccgcactcatggtaagtagaaaaagaaaactctcacaaaaatctgagtggcacagcttttccaaatacgctttttaaacttggagaaataaagatgtattacccgctggtgccttaaaatatccttttctccggttgtccaataatttatgttacggcggctatttgagtttttgtggaaatctctatcattaataaatgtcagccttgtgtcttaaatgcaattcaacagggaaaaggcgcgagacttcggcggcaaaaagccacagacaagtgctggttgcaaagaggtaaagaagtaatgagtgtaatcaaatagatatattaaggtagcaactcaccggtctgtccattttcttttcctgaataacttcttctgtcttcacacattcatttcatttttattttccaatatcactcaacgagaaagaagttacaagatctatctttcaaaatagtttacagttacctttactttaccctttcccttttcagtttgttaccccttctcctaaaagttttattttttgggtaaagatataaaggacactccagtcggttaaggtggctgtctagagaatataaacctgtatttatttaccaggcttatcagaaaagttaatcgtgttcttaaatattcattgaaaaggaacgtgatacagacgtaataaaagaagagtactaagcttaacttaataggtcatttatggttgaaaaacgtagtagacagagttccagtagtggctcagagttcagtgttccacctgatgtcgataacccgccactttctatccctttgaagactttatcagacagatatcagctgatcgaaaaactaggtgcaggatcatttggttgtgtaactttagccaaagcgcaatttcctttatcgaacatattgggtaaacaacatgatataaggggtactttaatggatcagcctaaaaatggtcaccaaaactatataacaaagacacaaggtgtagtggctataaagacaatgatgacaaaactgcatacactccaggattatacgagggtcagagaaattaagttcatactggcaatcccagcgaatgaccatctgatacaaatttttgaggtctttattgactctgaaaattaccaattacatatcgtaatggaatgtatggagcaaaacctatatcaaatgatgaaacatagaaggcgccgagttttttcgattccttctttgaaatctattctatcgcagatactggctgggttaaaacacatccacgaacataatttcttccacagagatttaaaacctgaaaatattcttatcacaccaagtacccagtattttgaaaaggagtacatgaaccagattggatatcaagataactatgtcattaaacttgcagattttggtttggcacgccatgttgaaaataaaaacccgtatacggcctacgtttccacaagatggtatagatcgcctgaaatattattaagaagtggttactattccaaacctttggatatttgggcattcgggtgcgtggcggtggaagttactgtattcagagctctcttccccggtgctaacgaaatcgatcagatatggaaaattttagaagttcttggtacacctatcaaacgttctgattttgttaatacaaaccacatcacagctccaccacctggtggattttgggatgatgccagtaatttggtccataaattaaacttgaaattgccttatgtagaaggttcatcgttggatcatctactttctagctcccaactatccgatttatctgaggttgtcaaaaagtgtttaagatgggatcctaatgaaagggcaacagcccaagagctttgtgaaatgccattttttgaaaacaccgtggcagcccaagtagacgcaagaggcaatgtgactaatacagaacaagcattgatttttgcaggtataaatccagtagcgaccaacacaaagcccatatattttaactcttcaacaaaattgcccgcagaaacagagtctaatgatattgatatcagcaacaacgatcacgattctcatgctatgtgctcaccaacattaaatcaagaaaaactaactttggtagaatttttaaacgaattcgttgaagaagataatgatgatcgctcaatacctgatgttggaacagattctaccatttcagattctattgatgagactgaattatcaaaagaaattcgtaataatttggccctttgtcaactaccagatgaagaagtcttagatcattcattatcgaatattaggcagttgacaaatgatattgaaattataaataaagatgaagcagacaacatggaacagctattttttgacctggaaattcctgaaaaggatgagtttcagagaaaacaaccatttaatgaacatgcagatattgatgaagacatcgttctaccatatgggaacaactcaaattacacacatacagataggtcacatcatagaggtgataatgttttgggtgatgcctctttaggcgattcgtttaattcaatgccagattttactccaagaaatttcttgatacctacattaaaaaaatcacgggaaaagttcgagcctcatctatccaattcaaaccaacattttggaaatgtaaccttctaataatttgtcatttgactgacgaatcgttaggcacagttatatagttatatacacatagacatacatatgttcgcatatatattatattactatgcattcacctaaatagctactgctctattaatacagtgcttttttgatggctttaatttaacttattagacattactttgcgtttattcccctccaatatatttttatgtttgtttttcttgaacattttatgatttcttgctcttggcggctactgattttgttaagcaactcatcaagaggtcaaaaaaagtagaacgagatctttgtgttcggttacccggctcagatcctaacttggtatgtttattcgtataagttactgttgtccacaggcaatactctgcagaaaattaaaacggcattaatgctaggacaaccagaactgttactactgtatgtgcgatagttgataactgcaacattatgcccggtatattctcaaaaaaccctattactgcatacgaagaaatcgcaagagaaatctttcggtttggaaaagctcactgtgaggttccttggagccaatagtaatacagcacaatccaaggaaaaatctggcctatatgcaaggaaggagagatagtcaaaagcattctttcccctagaagttggtgcatatatggcatcgttaaaacatattacccccaaaatttcttctctaaacgatgtgcttggcctttgttttggtttttgatgtcggtcgtttgaggccccttgcggaaaatcgagatcgccgaatggcacgcgagggaagggaaataaggtttaaaggcactgaaacaataggcaagaagtaggcgagagccgacatacgagactaatgtgtccgcgtttctaaggccacttttcaatggaacggatattgatatgctagtaaaaggacgagctcaagagcgaaaatataagtaaagaattcgagtgcacttgtctccatgcagcaagatttcatatgagtcttttttat

SEQ ID NO: 88 - protein, 645 aa, Saccharomyces cerevisiae
MVEKRSRQSSSSGSEFSVPPDVDNPPLSIPLKTLSDRYQLIEKLGAGSFGCVTLAKAQFPLSNILGKQHDIRGTLMDQPKNGHQNYITKTQGVVAIKTMMTKLHTLQDYTRVREIKFILAIPANDHLIQIFEVFIDSENYQLHIVMECMEQNLYQMMKHRRRRVFSIPSLKSILSQILAGLKHIHEHNFFHRDLKPENILITPSTQYFEKEYMNQIGYQDNYVIKLADFGLARHVENKNPYTAYVSTRWYRSPEILLRSGYYSKPLDIWAFGCVAVEVTVFRALFPGANEIDQIWKILEVLGTPIKRSDFVNTNHITAPPPGGFWDDASNLVHKLNLKLPYVEGSSLDHLLSSSQLSDLSEVVKKCLRWDPNERATAQELCEMPFFENTVAAQVDARGNVTNTEQALIFAGINPVATNTKPIYFNSSTKLPAETESNDIDISNNDHDSHAMCSPTLNQEKLTLVEFLNEFVEEDNDDRSIPDVGTDSTISDSIDETELSKEIRNNLALCQLPDEEVLDHSLSNIRQLTNDIEIINKDEADNMEQLFFDLEIPEKDEFQRKQPFNEHADIDEDIVLPYGNNSNYTHTDRSHHRGDNVLGDASLGDSFNSMPDFTPRNFLIPTLKKSREKFEPHLSNSNQHFGNVTF

SEQ ID NO: 89 - DNA, 3884 bp, Saccharomyces cerevisiae; identical to SEQ ID NO: 61

SEQ ID NO: 90 - protein, 627 aa, Saccharomyces cerevisiae; identical to SEQ ID NO: 62

SEQ ID NO: 91 - DNA, 3197 bp, Saccharomyces cerevisiae
taatgcccattatgccaataaagacttgccgctacatacagatttaccatttttagaaaatgtgccaggtttccagattctacaatctctacctgctacagaaggggaagatcccaatactagacccatgaattacttcgtggacgccttttatgctacccgtaatgttagagaatcggattttgaggcttatgaggctttacaaattgttcctgtaaattatatatatgaaaacggcgataagaggtactaccaatccaaacctttaatcgaacatcacgacattaacgaggacaatactcttctgggtaattatgaggccttgattaaatgcattaactactctccaccataccaagcacctttcactttcggaatttatgataagccctcagatctaaataataatccggacttgaatttaattaccaccccagcaaaactaacagagagatttttgtttaagtctttcattagggggttgaacttgttcgagagtcatatcaatgacttcaacaatcaatttagattgcagttgcccgaaaactgttgtgttatctttaacaacaggagaattttgcatgctaactctttaacaagctcaaaccagcaatggttaaagggttgctatttcgattctgatactttcaagagtaaattaaagttcttggaagagaagtttcctcatgacaaataacttcattttttcagcgtagttatgtgattctttatatttatttattttctctctgtgtagtgacaatttttttttaatgtttcatgttaaatatatttatattaagaagccgtcagtttccttttgtttcattgaaatcaataactaaaattaaaattataaaaggaataacgtaaaagaaagtctactacccaaggaaaatctactttatttagtgattatattcaactaaatatcattcaaataacctcacatatttgtcttcacccttaagagtttacgatttactaagttcaccttctcatggctttggagggattgcggaaaaaatataaaacaaggcaggaattggtcaaagcactcactcctaaaagacggtccattcacttgaactccaatggtcactccaacggaactccctgttcaaacgcagatgttttggctcatattaagcatttcctgtcattggcggctaattcattagagcaacatcaacagcctatttcaatcgtctttcaaaacaaaaaaaaaaaaggcgatacaagcagtcctgacattcacacaacattggacttccctttgaatggcccgcatctatgcactcatcagttcaagttgaaaagatgcgcaatccttttaaacttattgaaagtcgttatggaaaaattaccgctaggtaaaaacactacagtgagagatatcttctactccaacgtggaattgtttcaaagacaagcaaacgtagtccagtggctggacgttatacgctttaatttcaagctctctccaagaaaatccttaaacattataccagctcaaaagggtttagtttattcgcctttccccattgatatttatgacaatattctgacatgtgaaaatgaaccaaagatgcaaaagcaaacaattttccctggtaagccctgtctaattccatttttccaagatgatgcggtcatcaagttagggacaacaagtatgtgtaatattgtaatagtggaaaaagaagctgtcttcaccaaattagtaaataattatcacaagttgagtacaaataccatgctcattacaggtaagggatttccagatttcttgacaaggttattcctaaaaaaactagaacaatattgctccaaattgatatcggactgttctatatttaccgatgcggacccctatgggattagcatagccctaaattatactcactcgaatgaacgcaacgcttatatttgcacgatggcaaactataaaggaattcgtattacgcaagttttagcacaaaataatgaagtgcataacaaatccattcaattgttgagtttgaatcagcgcgactactccttagccaagaatttgatagcatctctgactgccaacagctgggatattgcaacttcaccattaaagaacgtcgtcatagaatgtcagcgggaaatttttttccaaaagaaagctgaaatgaacgagattgatgccagaatttttaaatacaaatgaataagaatgggagctgttgctttataaaaaatgtttttcaagaattgaaaacggttacatttaaatattatataaattgaaatctttgataatgagtactagtccaaaaaaaaatacaatttcaaaaaaataaatgccatctcctagaatcgaaccagggtttcatcggccacaacgatgtgtactaaccactatactaagatggcatatgattttacaatgattcgatggtgaatgagttataagccatgtaaggatcactagtcttttttcttaagtaactttttcgcttgtgatatcttgaaataccattaaacatagataagctattgaaatgtgaagaaaattcaaaaaaaaaagggaacagagtcatcttttgggtagaaactaagcttcaatggatgaatgtttacccaattcatgtctactaggtgttcacctcgtcatttcaacgcattcggggccacaaatagtttatcactacccaccctccaatacagcatttctaacaaataatccaacgaagcatcagcacctctatggaaaccatgcaaatctaaataaaaacacaagtacaaataaagaagaaaaactctttaattctggctctacgaaaacagcttctcaaattgctctaaacgagtcagcgaaaagttacaataccgctattacgccatcaatgacaaatactaatactaataatgtgacattacctccaactagatcacatgctaatactgtaggatcacaaagttcaattcctgcggctactaatggtgtaggttatagaaaaaccgatatcgaagatacttctcggacttttcaataccaagaaactgaatctgaaacgtcatcatcgggattaagtgacagcgaattgtccacagactacttagacatttctagcgattcgttttctatatcttcttccttatcgtcatcttctttatcttcttctccctcaagttcatcctcatcttcccctccgcaagatggctta

SEQ ID NO: 92 - protein, 398 aa, Saccharomyces cerevisiae
MALEGLRKKYKTRQELVKALTPKRRSIHLNSNGHSNGTPCSNADVLAHIKHFLSLAANSLEQHQQPISIVFQNKKKKGDTSSPDIHTTLDFPLNGPHLCTHQFKLKRCAILLNLLKVVMEKLPLGKNTTVRDIFYSNVELFQRQANVVQWLDVIRFNFKLSPRKSLNIIPAQKGLVYSPFPIDIYDNILTCENEPKMQKQTIFPGKPCLIPFFQDDAVIKLGTTSMCNIVIVEKEAVFTKLVNNYHKLSTNTMLITGKGFPDFLTRLFLKKLEQYCSKLISDCSIFTDADPYGISIALNYTHSNERNAYICTMANYKGIRITQVLAQNNEVHNKSIQLLSLNQRDYSLAKNLIASLTANSWDIATSPLKNVVIECQREIFFQKKAEMNEIDARIFKYK

SEQ ID NO: 93 - DNA, 3194 bp, Saccharomyces cerevisiae; identical to SEQ ID NO: 65

SEQ ID NO: 94 - protein, 397 aa, Saccharomyces cerevisiae; identical to SEQ ID NO: 66

SEQ ID NO: 95 - DNA, 3875 bp, Saccharomyces cerevisiae; identical to SEQ ID NO: 67

SEQ ID NO: 96 - protein, 593 aa, Saccharomyces cerevisiae; identical to SEQ ID NO: 68

SEQ ID NO: 97 - DNA, 2727 bp, Saccharomyces cerevisiae
caaaaaatgtatacaaactcttaggattggtcaagaaaagtaaatgttgtactgctccaaagatattgcgatgccgtgataattcaaaagggtcgacccagtctatttcactcgcgcgataatcgttcgttatccgaagctggccaattgatacaattaattgacatcagcagacagcaaatgcacttgatatacgcagcttaaagcaagggtaaattatctgaaaaaggattgaatacaatcaaaaccttcacatacattggtagtaatatcgagcatcgctattagcagagtatctcgaagtctaccacggcgaaagttgattttttatctgaggtgctgatcttcggacgcaatgcgcaaacgtaattccgtagttttcccaattattttattttttaaattacacgtaccaggtagatcacatacgtatacccaacacctgttatatagtgaattgaattattcggaacatcaataatcctttgcttataattcttgttatcatccatcttgcatctttatttaattatattttgcacaataagctatctatgtgagctgcgtacggtgactccaaacaatctgttaatttccatataaataacttgtagtcggatcgtacaatggctctatataggtttggaccggtatgtaacctaatatggctgactcaaaacctgctagatagttatccaagtgaatttgagtctcgtatcctttatcacatttttacaatagtggctagctatctttttcatgttaggctcacccggtattctcatgcaagatcaaacaaaaaatggtaaagttttggactttacattgcttacagttgcttttttatgaagattcaaaagattatgtcctcggcggctaaattttccattaataatattatccttttacgcgaccgaaaaagagaagcgttttaagagttgtttctaacaaatattaataataaagctaacgtgaactgaccaggctctatttgaaagatatggcaccgaaaaagaaatcaaacgatagagccattcaggcaaaaggctcagaaggttaagtatttttttacatgctcatcaaataccgccattactaacaattgtaccccgggtattttatcagctgaacaattaatagaagattacttggtgtcacaatataaaccattttctgtaaatgatatagttcagaatttgcacaataaagtgacaaaaacaacagcaaccaaagcattagaaaatctcgttaacgagaaacgcatagtgtctaaaaccttcggaaagattataatttactcttgtaatgaacaagatacagcattaccaagcaatattgatccttctcagtttgattttgaaactgtattgcaactgagaaatgatttaatagaactagagagagataaatcaatggccaaagacgctcttgactctgtaactaaagaacctgaaaatgaagatctcctaacaatcattgaaaacgaagaaaacgagctgaaaaagattgaatcaaaattacaaagtctacaggatgattgggatccagcaaatgatgagattgtcaagcggataatgtctgaagatacgctgctacaaaaagaaatcacgaagagatcaaagatttgcaaaaacctaattgctacaataaaggactcagtgtgcccgaaaaatatgaatgaatttttggtatgtattttgaacatttttcgaaaccttttcttttgaatatactaacgaaatctttacaggaagaaattggatttgaggacatttgatgtgaaaagcaattagttgttccgtaccggaacacttgctattttacttatcatgattgtttttttttctcattctttgctattattatcaaattatatataggtaaataatcttacactagtttataagtgtcacgaacgatgaaatggaaacttgggggggaaggctcaaaaaacatactgtgtgtttatggggctgcctttgctagttgttgaggggtgagaaccgcaattactgacaaacgttactgatttgtaatattcaaaaactccttgcattgccttcccgttggccaaaatagtagtcgttgacaaagagtacggcgtcgattctaaagttggtgaggggatttgctcgcatatagttgtcagttcctgtgctaaaactgaagcaataacagaaaatattgaaaaacagcgaagtaactgcatcttaattgaaaatgtatgaagtaggtataatattttggcacacaagtgactgttgagagcttacaatcattctagaatgaggaatacgtcaaaatggaaacttaacatatcacctcttcttacaactatttatattgtatatttacaagtgaaatcaattgcctgatattcagtatattggatctgaaggtatgaaacagtcccttaattaagctttagatgtggacagaagtttttttgttaaacttgcatgtcaaatttcaaactgcgtgtaattaccgtattcggaaattacatggtttcagtaattttgcaataaacgcagcaaccggtgatggcgaagttttaccatcaaacaataacttataataactgaatgccggcaggttgaaacaaattcttgaaaattagtcatttattctattgtgcgaatgtaatccactgaaatcatctaaagcaccattaccattgtctagcctgtgaataaaaaaatatgggagtataatgatagagaagtg

SEQ ID NO: 98 - protein, 218 aa, Saccharomyces cerevisiae; identical to SEQ ID NO: 70

SEQ ID NO: 99 - DNA, 3830 bp, Saccharomyces cerevisiae
ggctgtctttattgttcgtgatactttggttggccggcgatgtctttaaccttatgggtgccgttatgcaacatcttttgtctaccatgatcattcttgctgcttactatacggtggcagatatcattttactaggtcaatgtctatggtacgataatgaggaaaaaccagcagtagaccctattcatctctcccctgccaatccaataaacgaaaacgttctgcacgatgtgttcaatgaacaacaaccgcttttgaattcccaaggtcagccaaatcgtattgatgaagaaatggctgctccttcatccgacggaaacgttggtgatgataatctccgtgaagtcaattcaagaaatttgataaaagacatatttattgttagtggtgtagtttttgtaggtttcatctcgtggtatgtaacctactgcgtaaactacacgcaacctcctcccgtggaggatccatcactgcctgttcccgaactgcagatcaattggatggctcagatattcggttacttaagtgcccttttgtatctgggttcaagaattcctcagatattactgaattttaagagaaagtcttgtgaaggtatcagtttcctattctttttgttcgcctgtttgggtaataccacatttattttctctgtgattgtcatttctttagactggaagtatctaattatgaacgcttcctggttggttggaagcataggtactctattcatggatttcgtcatattttcccagtttttcatctacaaaagaaataaaaaatttatactgaattaacatgttctatctaatatttatttaacatatttttgacctcacaaactttttttttttttctctctgtcattgacatttttttaatgtcacaaaaagaaaaattaaaagtattataagatttcatttaaataggaaaaaacccgtaattactaaaggcgtattaaagatctattaaagatctattaaagctttctgttaccagtatggataatattttaaaggcatcaaatatgaaagggacttcaacaatgacaattacctcgcgtagttctgaagactctagttgtatctcaaatcatgaacaagataccgatacacataaggacggcgacacaagtggtctggaaaacagtaaaatttcgaagagaaagtggatgaaagagtttttcaaactttccaaatctccagcttccaaaagcaaccggagtataggttccatgaaaagtaaccagagcctcatttcaatgaaaagtagtgacgatggcaacagttataaaaatgattactcttctatctgtggtaacagccttccatctgcaggcttgagtcgttcgaatagtgtgaaagaattaaaattagattcaactggaagtcagagatcaaaaaataatgttgccatgttagcatgttcttctacaacatctcagacaacgtgctcttcttcttcatcatcatcttcttataactctataaaaggaaatgaaaatgatattttattgcagaataacaatcactttaggcataacaaagaaattcctcaaagtaaagggagctccaacattaacaccgcatcgattatgagccaatacaatgtcgatacgcaagcaaccgctataatgagcgatatgcaaaagcaatacgactcgcaacagatgacatcaccatttgtaaacgaagacttgcatttcgatccaaatggtgaagtttcacacgtaataaaaacaatttttaaagaaattggttataaatacgatgatttcagtgatattcctgtttttcaattaatgcaagaaatgtatcaactagtgaagaagaattccagcgctagaagaacaaagataacagactatgcttctaaacttaaagaaaaagaagcgcaactaaaaagtcaaaatgacaaaattttgaagttagaaacaacaaacaaggcctacaaaactaaatacaaggaggtctctctggaaaataagaaaataaaagaggctttcaaagaactagacaatgagtcatacaatcatgatgaggaattactaaaaaaatacaaatatactagggaaaccttagatagggtcaatagagaacagcaattaatcattgatcaaaacgagtttttgaagaaaaatgtcaatgaactacaaaatgaggttaatgctaccaacttcaagttctctttatttaaagaaaaatatgcaaaattagcagatagcatcactgaattgaatacctctacgaaaaaaagagaggccctaggagaaaacttaacttttgaatgcaatgaattaaaagaaatatgtttgaaatacaaaaaaaacatcgaaaatatatcaaataccaataagaatttacaaaattcgttcaaaaatgaaaggaaaaaagttttagatttgagaaatgagagaaatttgttgaaaaaggaaatactgttgattgaatgtcatggttcatattctctactccttgtatctaatattctgacatgttatcggttcttactgccaagtgatactattattgaaactgaaagcttaattaaggagctactcaacatgaataattcactttcgaaccatgtgtcttcttctgacgagcctccagcggagtactcgaaaagattagaattaaaatgtgtagagtttgaggaaaagttactttatttctatcaagaacttgtgacgaagaaaattatagacgtcatttacaagtgctttattagttattacaagaaaagtaggcaaactgaccaaaaatccaatcagaactccagcactccgtataaacaaagccaaagacaagttccgcactccatcaagtgaacctcaacagctacacattcttttataatccttaatattctatatatacatatatgaaaaaatagaaaacgcgaaaacttgtcattttttttttaggcgtttttataataaactgaaaataaaaagaggctctttaaatgttgacactctactccaatatcaactgtaaaaaatctctttatctgctgacctaacatcaaaatcctcagattaaaagtatgtcctccactaggccagagctaaaattctctgatgtatcagaggagagaaacttctataagaagtatacagggttgccgaagaaaccattaaaaaccattagattagtggataaaggcgactattacacagttataggttcagatgcgatatttgttgcagattcagtctatcatactcaatctgttttaaagaactgtcaattggatcctgtaacggcaaagaacttccatgaaccaactaaatatgttactgtttcgctacaagttcttgccactctgctgaagttatgtttgttggatctaggatataaagttgagatatacgataagggttggaaattaattaaaagtgcatctccagggaacattgagcaagttaatgagttaatgaatatgaacattgattcgagtatcatcattgcaagtttgaaagttcaatggaattcccaagatgggaactgcattattggagttgctttcattgataccactgcatacaaggtgggcatgcttgatattgtcgataatgaagtgtattccaacctagagagtttcttgattcaattgggtgtaaaggaatgtttgctgcaggacttaacatcaaattcaaactccaatgctgaaatgcagaaagtaataaatgtaattgatcgctgtgggtgcgtcgttacattattgaaaaactcagaattttctgaaaaagatgtcgaactggatttaaccaagttactgggcgatgatttggcattatcgttaccacaaaaatactctaaactatc

SEQ ID NO: 100 - protein, 609 aa, Saccharomyces cerevisiae
MDNILKASNMKGTSTMTITSRSSEDSSCISNHEQDTDTHKDGDTSGLENSKISKRKWMKEFFKLSKSPASKSNRSIGSMKSNQSLISMKSSDDGNSYKNDYSSICGNSLPSAGLSRSNSVKELKLDSTGSQRSKNNVAMLACSSTTSQTTCSSSSSSSSYNSIKGNENDILLQNNNHFRHNKEIPQSKGSSNINTASIMSQYNVDTQATAIMSDMQKQYDSQQMTSPFVNEDLHFDPNGEVSHVIKTIFKEIGYKYDDFSDIPVFQLMQEMYQLVKKNSSARRTKITDYASKLKEKEAQLKSQNDKILKLETTNKAYKTKYKEVSLENKKIKEAFKELDNESYNHDEELLKKYKYTRETLDRVNREQQLIIDQNEFLKKNVNELQNEVNATNFKFSLFKEKYAKLADSITELNTSTKKREALGENLTFECNELKEICLKYKKNIENISNTNKNLQNSFKNERKKVLDLRNERNLLKKEILLIECHGSYSLLLVSNILTCYRFLLPSDTIIETESLIKELLNMNNSLSNHVSSSDEPPAEYSKRLELKCVEFEEKLLYFYQELVTKKIIDVIYKCFISYYKKSRQTDQKSNQNSSTPYKQSQRQVPHSIK

SEQ ID NO: 101 - DNA, 4754 bp, Saccharomyces cerevisiae
atttcaaagcagtttgtgcaatttgtccagcagttctgtatttgttcaagaccgattcctgtagaatatttttgtcctttagcaaaatctgagtatcctcgtgggagatagctagagccatgatagttttagcaatattagtcgggtcgggttttttcttaaaagtattttgaataacacgatgctttagctcatctcatctcttctgctgaaatttttctttacttcggtaaaattttttcagaaagcaaaaaaagcttcagaggcatgaccctctccgggtaaaaaaagcttagggttaccggcctgtcatttttagggcattatcaattttttgccatctagttgcaactataataatacagtatgaattgcacgaaagagcagtcaatgtaaattcacgaagtgactgacagaatactgacatcagctgatttctcatagagctgtttctctgataacacgttgtttgaacatcgacaagatgaaaatctagaagtatcaaatttcctttaaagggatatataacagattctaaaactgacagaaatatttcgagtgaagaagaagcgttaaatattggatctttccgcagttctactctgatacatttttgaagtaggagagtcatttagaaggcgtattgctcaatagtagaaagcaggcctgtgcacatgaattaattaaaaaatataaaggtagtgattagacgacacatgtccataggtaacctgtcataattttgaacaatttccctttttttcttttttttttttgggtgcggcgatatgtagcttgttaatttacacatcatgtacttttctgcatcaaaatatgaaaggcgatagtagctaaagaaaataccgagaatttcctcgaaaagttgacgacaaaagaaaggcataaaaaagtaatttgaaaatattttaaaactgttttaacccatctagcatccgcgctaaaaaaggaagatacaggatacagcggaaacaacttttaaatgatggaaactcctacagacaatatagtttccccttttcacaattttggtagctcgacacaatatagtggtaccttgtcgagaacgcccaaccaaataatagagctagagaagcccagcactctatctccattgtcaagaggaaaaaaatggacggaaaagttagccaggttccaaagaagtagtgctaaaaagaaaagattctcaccttctcctatttcctcctctacattttcgttctcacccaaatctagggtcacttcttcaaactcttctggcaatgaagacggtaatctaatgaatacaccttctacggtttccactgattatttaccacaacaccctcacagaacatcgtctttgccaagacctaattccaatctctttcacgcaagtaatagtaacctatcccgagcaaatgagcctccaagggccgaaaatttatcagataatataccacccaaggtcgctccatttggctatccaatacaaagaacctctattaaaaaatcctttttgaatgcttcttgtacgttatgtgacgagcctatttctaacagaagaaagggagagaaaattatagagcttgcatgtggccacttaagtcaccaagaatgtcttattatctcttttggcaccacttcaaaggcagacgttcgtgcgctatttcctttttgtaccaaatgtaaaaaagatactaacaaagccgttcaatgcattccagaaaatgatgaactaaaggatattctaatttctgattttttgattcataagattcctgattctgagttatcaatcacacctcagtcccgctttcctccttattcaccactcttgcctccttttggtttatcctatacacctgttgaaagacaaacgatatattctcaagctccaagtctaaacccaaatctcatattggctgcaccccccaaggaaagaaaccaaattccacaaaaaaaatcaaactatacatttttacattcactcctggggcacagaagaattccgtccggagcaaactctatcttagcagacacctctgtagcgttatcagctaatgattctatttctgctgtttccaattcggtaagagcaaaggatgacgaaaccaaaataacgttgccgctgttaaggtcatattttattcaaattcttttgaacaatttccaggaagaattgcaggattggagaatagacggggactatggattactaaggttggtagacaaattgatgatttccaaagatggtcagagatatatacaatgctggtgtttcttatttgaagacgcatttgtaatagcagaagtggataacgatgttgatgttttggaaactagactaaagaatttagaagtatttacacctattgccaacttgagaatgactacactcgaagcttcagtactcaaatgcaccttaaataaacaacattgcgccgatttatcagatctttacattgttcagaatataaattctgacgaaagcacaactgtacagaaatggatatctggtatattgaatcaggattttgtattcaatgaggacaatatcacttccaccctgcctattcttcccattataaagaacttttcaaaagatgttggtaatggtaggtacgagacgagtacctttctaggtttaatcaatcctaacaaagttgttgaagttgcaaatgtgcacgataatgatactgtaatcataaggaggggattcaccttaaattcaggagaatgttctaggcagagtactgttgacagtatacaatctgttctaactacgataagctcaattctttccttaaaacgagaaaaacctgataatttggcaataatcttacagattgactttacgaaattgaaggaagaagacagtttaattgttatttataacagcctaaaagctttaaccattaaatttgcgcgtttgcagttttgtttcgttgatcgaaataattatgttctggactatggatcggtattacacaagatagattcactagattccatctcaaatctcaaatcaaagagttcctcgacacaattttcacctatttggctgaaaaatactctatatcccgaaaatattcatgaacatttgggtattgttgctgtatcaaatagtaatatggaagcaaaaaaatccgtactatttcaagattacagatgctttacaagttttggaagaagaaggcccaatgaattgaagattaaggtgggctatttgaacgttgactacagtgataaaattgatgaactagtcgaggccagctcctggacttttgttttagaaactctttgctacagtttcggtctaagttttgatgaagatgatgacgatgacgaagaggataatgatgattcgaccgataatgaacttgataatagttcaggattactgtcggatgctgaatctacaaccactattcatattgactctccatttgataatgaaaatgctaccgcaaatatggtgaatgacagaaaccttctcactgagggtgaacatagcaatatagaaaacttagaaactgtcgcttcttcagtacagccagctctgattcctaatattagattttcacttcattctgaggaggagggtactaatgaaaatgaaaatgaaaatgatatgccagtattattacttagtgatatggataaaggaatcgatggcataaccagacgcagttcattctcgagtcttatagagagcggtaataacaactgtcccctccatatggattatatatagagtatacactaaattttatgcaataataaaaaggaagcatcccgccaaacgtttcttaactacatattgttacatagcttgattccgtgaatttgaagtggacgcagttcttcttagtctttcaagttcatagtaaatagacattacccaaagatctctttcctgtcttgatcttgccatgaaaaccattgacttgccgctcacacctaactttttagtgaaatggatcttatctgtgttacttggaacattagtgttattcaagtcagcttccggagcagaaggtgggtcaatattattatcttgtctaccataatcttgcgtatattgcttttcattccctttcttctgtaagcgattgctagaaagggcacgccttgttccaaaccaaagcgtaaagcatcgcgaactctcgtcttctacagatcgccatccgtccccataaactcgtgggagagcgtgggatccatagtttatttcgtcaaaagtacgatctctctgcagaaggtctagttctgttgtggtcccagagtataggtagcaatcgtcaatcggaatggttacataatgagcatactccaaaacttccttagcaaaacctgtggttgatctatgaaagcagtggaacagtacaataaaacctgatatcaaaacgacgtagtacttcgagaaaacagaatgcttgtgcggcttttgatataaaggtcccttttgaattaacggcctacttaatgatattccatttgcattaaaggtttgctcatctgcacgcccatgttctacgatccagcgcaatgtattctcaccaatttttgtttcctcttctccatttagcatcaaaagacctgcatttgaacgccttatttttaaaagcctctccgtatcttccctttgcttgtttttccaataggatatcatttgtttcagctttatgacccactcttcagcaactgttgctgatgtagcaagcagcttcaagaggagtccatttgaggtttct

SEQ ID NO: 102 - protein, 917 aa, Saccharomyces cerevisiae; identical to SEQ ID NO: 74

SEQ ID NO: 103 - DNA, 3272 bp, Saccharomyces cerevisiae
gacagaaatatttgaaatatatttcctcaaagagtacactagatccattcatattttaggcttcctatggaaaccgttttttcaaggataaaccccgccatatgttctttgcgaagtcttttgcagttaaaactaattacaactctgttatttactgacacctgcgttaaaattttatcacaatatgtcatccgctgagagagatgtactatttataattacttaagagcgactacttcatttaccattagcgagcagaagaacagcttacttgtcgatgttcttctctggctaaatgaaatgtcaattattgagattgagatgggtatgtatgatcggattttgatatcagccgatgagacgaagattcaatagcttcaaccgtccctgcggggggtacttaccttttgtaaccagtaccctgtgcaaattctcggcgtgtactacctcttttgggaccacaaccctttgtacgcactttcgtcagatgcaaatttttacacgcgttgaaaaatgtttcaggaagagatactgcgtaaaaaaagacacatgtgttacgcaggaaaaagtttgtgaggctttttgccttaacagattgacttgtagccctgttaggtttacccaacagttgtttttctgtgtgtcgaaaattttttcagattgttttcaactgacacttgcctgtttcatattagttgtaacttaaactttcaaacataaaacttttttggaagtccatccttcacatgacttgaatcccttcaatatcgaaacagtatcctcaaaatctcttatcacttttctaattgttttcttcccctttttgtagtaactcgctgtaaagcacattttattcataatctcctttgtgccagaactcaaggtcaataggccagaattattggaaggaaagagggaagaaaatacgatattgctagttcattaagtcaaggaagaaaatactcaaaaaactgtacagctcaatcaggtacacattacgatggcagcacatcagatggactcgataacgtattctaataatgtcacccaacagtatatacaaccacaaagtctacaggatatctctgcagtggaggatgaaattcaaaataaaatagaggccgccagacaagagagtaaacagcttcatgctcaaataaataaagcaaaacacaagatacaagatgcaagcttattccagatggccaacaaagttacttcgttgaccaaaaataagatcaacttaaagccaaatatcgtgttgaaaggccataataataaaatctcagattttcggtggagtcgagattcaaaacgtattttgagtgcaagtcaagatggctttatgcttatatgggacagtgcttcaggtttaaaacagaacgctattccattagattctcaatgggttctttcctgcgctatttcgccatcgagtactttggtagcaagcgcaggattaaacaataactgtaccatttatagagtttcgaaagaaaacagagtagcgcaaaacgttgcgtcaattttcaaaggacatacttgctatatttctgacattgaatttacagataacgcacatatattgacagcaagtggggatatgacatgtgccttgtgggatataccgaaagcaaagagggtgagagaatattctgaccatttaggtgatgttttggcattagctattcctgaagagccaaactcagaaaattcttcgaacacattcgctagctgtggatcagacgggtatacttacatatgggatagcagatctccgtccgctgtacaaagcttttacgttaacgatagtgatattaatgcacttcgttttttcaaagacgggatgtcgattgttgcaggaagtgacaatggtgcgataaatatgtatgatttaaggtcggactgttctattgctactttttctctttttcgaggttatgaagaacgtacccctacccctacttatatggcagctaacatggagtacaataccgcgcaatcgccacaaactttaaaatcaacaagctcaagctatctagacaaccaaggcgttgtttctttagattttagtgcatctggaagattgatgtactcatgctatacagacattggttgtgttgtgtgggatgtattaaaaggagagattgttggaaaattagaaggtcatggtggcagagtcactggtgtgcgctcgagtccagatgggttagctgtatgtacaggttcatgggactcaaccatgaaaatatggtctccaggttatcaatagcttcgaattggaaatactgtgagcagtaattatcaatggatgctattatataaatatacatacctacacccatcccatatttacatagaataacaacagtaacattagttctgtggaagcgcaaaaacgtcctttaataaagtaagtcaaaacattcaacaatgaaaattcaaagcattgtcatttgcttcctttttctctttggataaacgaaacaaaaacgaacaaaagtgtcatgcactcaaaaattcttttcaatcgttttggaaacagtattattcactgacttatttgaccaacttgctagaatcatctatgttttcaggcattgtttaatttcatgatggctgtccctactttagcttgttatgagccttcactggctcgtccttatgtattgcgtctgacccaaaatttgtcctttcttgtttagtggaatttttgttcggtaatttcaaaaatgcctgaattttcattaacaaatcatctggtagttgtgttataaacataaaaaactgctcccttctgggatgattttcaattgctctctgtactgcaggatcattcaatatcatctgaaccacgtccgtcatcatatcctcatctataagcgcaaggcttttaatccagggcaaatcggctatacgaagagacatttcttcctccggagacactactttccacgggagatcaaaatatttagatagttcactattgagatgtgagaattcatgaggcacatcaacggtatagtcaactgcatatgcatcatcttcaaacgttaagtcatgttcaatgctaaactttccagcgttacctataaaaaagcattctatttttaagttaaactctccccaaccggtttccttgataaaaaatggcagcgagttcagtcgtcttttgggctgtttgaagctagagtgcaaatggtagatgcatttagagaggatggtaggctccacttcctttcctgttgcatctaacatgaggagttccatct

SEQ ID NO: 104 - protein, 423 aa, Saccharomyces cerevisiae; identical to SEQ ID NO: 20

SEQ ID NO: 105 - DNA, 2333 bp, Saccharomyces cerevisiae
atattatatatatatatagggtcgtatatatatcgtgcgtcttcttccttctctaagggtaaaattccttgtatttgttataatagtagtaactgccgagcccacccaaagctgtcaaaacgacagggacaggtttagtgaacctggaaggcatgcctcttatgacaccagcaccaagtagtaaggtcgatgcacccaatgccatttcgagcccaccatctctattcatatgtagcaagtaaccggcaatcccatatacactaccgaatactaagccagatactagagatggaatggagcccttacggtagtatcccataaggccaccggctgtagtcaaaagactcaatgtatatgctggatgttccatagtgtgatctgatgttcctttctctcaaacttcgtttctgtcttgtctcccgctgttacctaataacttcatgtgatctgctcccccttctcgttaaataccaccttttcatcaaccccgtagggcgcgacacgtctaaaatattaacctctgaatacttattgggtcaaaatgaatgttgataactttcctttacaaaaaaaaaactaatagagtatatgcatttcggtagtgaaatattcgttaatgctaatatgctcagtagtgatcctagattaccagttttactgcagccatcgtacaattttggaacgagtataaagagagaaattaaaaacgacaagaaatattcgtactagcttctcttccggcttgatgacagtcttaatatcatctgcaactcttgaaatcttgctttatggtcaaaatttacgtacgcttttcattatataatatgatttgtcaatgtgatgagtgaatgtctccctgttacccggttttcatgttgatttttgtttcaggctctaaatgtttgatgcaatatttaacaaggagaacagaaatgttttgtgacagcacctgtcaattttaggatagtagcaatcgcaaacgttctcaataattctaagaatgacatcagttcaaaactctccacgcttacaacaacctcaggaacagcaacagcaacagcaacagctttccttaaagataaaacaattgaagttaaaaagaatcaacgaacttaacaataaactgaggaaagaactcagccgtgaaagaattactgcttcaaatgcatgtcttacaataataaactatacctcgaatacaaaagattatacattaccagaactatggggctaccccgtagcaggatcaaatcattttatagagggtttgaaaaatgctcaaaaaaatagccaaatgtcaaactcaaatagtgtttgttgtacgcttatgtaatgatagtaatagaatccaaaaaaaaaaaaaatatacatgctttttcatatcctctctcaccctatctttttttttcttctaattttggctccgttcatatcttattcaaaattaattcagcggtaatcttatctttattgttagacttcgcagaaatttcatttagcttcgatgcagatagtttgatcaagtcattttgtttattacgtcccagttcgcgagaaatgatgttaaccaatgcccacccttttaggtatagttcgctaagttcaacgctcctcaaagcattctttaatgccttttccaagagctcggtcttggtttgtttcttgctacgtagagcctcataatacagagtctcacttagcctaccaaaacaagcgtaattgaatggtgtaatacataggacctgttccaaacaataacgggctttttcaaattggcccatttcgaaataaatctcgctggcataccaccacaattctgcatcaagcgggaatttatctgtaagagccaccacttctttaagaatactttcttggctcaaattcttggaagttgtcttaatagctatcaatttctttgcaatagagacataagtaacgaagtccgtttcatactccagatcatcattcaacaaattttccagatattcaatagcgcctttatcatttccgtttatctgcaataaagtggctttcatgattaccattttatacgaattttcaccaagacgatctcttaatgtattataaacaacttgcgcatcaacgtcttggtttcggtacaccaaaacatagaaaagcatttccatcaagaagaaatagtttccttctgttagtccagagtctccacttttcatgtaaattttcatttcattttctagttgcagtaattgttctggattaaattgagtatacgctttggtattcataattgtcaaaagcttttctctaaccaaatccttcaacattgttttatctactgctttgtataattt

SEQ ID NO: 106 - protein, 110 aa, Saccharomyces cerevisiae; identical to SEQ ID NO: 22

SEQ ID NO: 107 - DNA, 4067 bp, Saccharomyces cerevisiae; identical to SEQ ID NO: 79

SEQ ID NO: 108 - protein, 688 aa, Saccharomyces cerevisiae; identical to SEQ ID NO: 24

SEQ ID NO: 109 - DNA, 3548 bp, Saccharomyces cerevisiae
accagtggtcaccatacatgaaataccacagtgttttcccaatgtacggacgacttgggaagtttgcagagctaactctcttgtgggaaccatgatcaaagcctgaattttattcaactttggtttgactttctctaacgtaggaataacaaatgcggctgtcttacctgtaccattctttgctctggccaatatgtctctaccagttattgctaccggaatagcctcttcttgaataggggatggtttttcaaaaccggcttcaaaaatacccattaacagctctcttttcaaataaaaatcttcaaaagtattaccctttgtatttaagacatcgtctgtctgtggtctggtatccttcttgggaatattcaatgcagttttccagtcccgatcgagatccgtattactgttattattagtgttgaagttattattgatggaacccattactactattttctttcttgtcgtattttaggcctgggataagttattatgcgaatggcgatgcggttatgaagaaataaaagggctaaaagtaagaattttctgcgtctatctttctattaggaataaaatatgactatatttactattattgttgttttgtcgtacaatcctttatgaatgaaaatattaagcttgtggtcttaaaagaatgtggatgaaacaaaactgaatccaatgatgagaaataaatgtacaatcagataataaacacttttattgatgattgtcttttcttgcaaaccccaatgttacaatcgcccattagttctaagattgtgttgtcctttttcttacgaaatttttttccctcccttttttgatcactgtcctcgttataagtgattcgtggggtaacggcgatatcatactattattggcccatctgatggattagaagacctacaggttaatgtgaagcgacactaatgataagaaaactgcatcggatcatatctgtttttgcagcgtggtatattggttgttggtcatgtttcaacgaaagactttacagagaaggaacttgaaagggctcaatcttaacctgcacccagatgtgggcaataatggccaattgcaggaaaagacagagactcaccagggacaatctcgaatagaaggccacgtgatgtctaacattaatgcaatacagaataatagcaacctgtttttgcgaagaggcataaaaaaaaaactgacgttggatgcgtttggtgatgaccaagctatatcgaaaccaaacactgtggtaatacagcaaccgcaaaatgaacctgttttagttctgtcttctctatcacaatccccgtgtgtaacatcatcatcatctttgtccacgccatgcattatagatgcgtacagtaataatttcggattatcgccatcatccacgaattctactccctctacgattcagggattgtccaatattgcaacgccagttgaaaacgaacattcgatatcactaccacctttggaggaaagcctatcgccagccgcagcagatctgaaagatacgttgtcgggaacttcaaatggtaattatatacaactccgggacttggttcagttggggaaaattggtgctggaaattctggaactgtggtgaaggcactacatgttcctgattccaaaatagttgccaaaaaaaccattcctgtggaacagaataacagtacaatcatcaaccaattagttagggaattatctatcgtcaaaaacgttaagccccatgaaaacattatcaccttctatggagcttattataaccagcatataaataatgaaatcataattttaatggaatactctgattgtggttctttagataaaatactgtccgtttataaaaggtttgttcaaagagggactgtttcgagtaagaaaacttggttcaacgaattaacaatatcaaaaatagcgtacggcgtactaaatggcttggatcatttgtaccgacaatataagataattcatcgtgatatcaagccttccaatgttctgattaatagtaaggggcagattaagttatgtgattttggagtttccaaaaaactaataaattctatcgctgatacatttgttggaacgtccacttatatgtcaccagagaggatacaaggaaacgtttattctatcaaaggggacgtttggtcattgggcttaatgatcatcgagctggtaactggagagtttcccctaggtgggcataacgatacacctgatggcatattggatttgctgcaacgtattgtcaacgagccttcaccaagattacccaaagaccgtatctattccaaggaaatgacagattttgtcaataggtgttgtattaagaatgaaagggaaaggtcatcgattcatgaattgctacatcatgatcttataatgaaatacgtatcaccgtctaaagatgataaatttagacattggtgtagaaaaataaaatctaaaataaaggaagacaagagaattaaaagagaagccttggaccgtgccaagttagaaaagaaacaatcggaaagatcaacccattgaatgcatgcgataacattagttaggaacatattgcactttttttcacatccctttctcaaaactatattcatatatatatagactctcctgattatgtaaatcacaaaccaattttctaatgtaacaatatttttaaaaataatcatcaaagtagcactttatgtacagaaaatttcacgattgagagaagcttgcgaataatactagttagcctgtgtttcaccatcgttacttaatttcttatagttcttatattctttatttttatgccacaaccaaccttcggttcctctaacgaaaccgaaggcgattaataacccaccgaagctacgtaaagttactttccaccattgtgggtttcttttttcaaattcagtcagagaaatgcctcttttgccttcttgtttaccatacttgaatggtttcccagatgccaagtatgagccaaatccaacagaaaacatagtgctcatgacttgacaaggaacgcaatccatagtctcttctttttccagctccctttgtggtggagggttgaacactgccaaaatattactcattatttttcaccgcttgctgtttctctctaagcggtgttttgtttcctacttggtggcacacaatgactgtactcgctttatatgctcgtaccttttttcaaaagcccatcgttaatttttcacccgaggaccccatattacgcgttttttgttaatgttcaatttccgacatgttacaattataataacgccaaaagaggtaaatgtatatttgaacaattgttaaagagaagataaaaaccctttaatcttgcatttgtcgtcaatagtacacaataggcgatctattttagtacggcaattaaaagaaagctgcttttcagtcaagaatgccggaattaacagaatttcagaaaaaacgtttagagaacatcaaaaggaataacgatttattgaaaaaactccatttgtctggagtagcatctcaaatcaagcacgag

SEQ ID NO: 110 - protein, 515 aa, Saccharomyces cerevisiae; identical to SEQ ID NO: 82

SEQ ID NO: 111 - DNA, 4154 bp, Saccharomyces cerevisiae
taaaacatccttcataaaaacaaccaatatgaaaacattcgtgatagcctatatttacaactagcttatcgtcatttgagaatccctctagacctttattttggaaccatagattatcaacgtgtgatatcgggagtgcaaggtcgaaaccgatgtgctcttcaactcttggcgcctgtaggaagtaaaatagggcaatcactacaaaaactaccaagtataataggtacctttgatacagcctcggtaaccggatcatgttaagatttttaaccacggtgctggtcttcgataattaagtataaaacttgtatcagaggtatctgcgatctaaaaagattaatttttgaaaaagatcaacactaaaccatttgaaattcaaaaagcacctaaggcaaaatataaatctaaatatacgtaaaatggaaacactttctgcgcagctttatacaagttagccttctagcttatgaaatagaaatgaaatataactgagcaagtcctatatacaatactattaatgatcttcttgtccatgagactgttcatggtgccttttagagacttcttcatcacttagctgaggcctgtggccacccgttctcaataaaccaccggcagtatcctcaactggaaatcttgcactgggccttacgcaatggggcttgcgtaactgttcaaaatccatgattttagttttccctcccccttttaaagtaatctttggattctcgcccaatttttgctccacttcttttatattttgggtgcgttctttactattattattattattattattactaactgccattatagtttctttatgctgtcctcaccatgcctttcgttatcaggctagcattaaaagccttttaaggtgtaaagctttcgccgcgatggctttaaacagtagaaaatattcatatttacacacatgcataaagagagaccacttaataaagctagtatgataagatcaccggtagacgaaatatacatggaacagacacaaacagcagagggcactgacttactaattggtgacgaaaagaccaacgatttaccttttgtgcagttatttctggaggaaataggatgcactcaatacctggatagctttattcagtgcaaccttgtcacagaagaagaaattaagtatctcgacaaggatattctcattgctttgggtgtaaacaaaataggagacagactcaaaattttaaggaagtcaaaatcgttccagagagataaacggattgaacaggtgaatagattgaagaacctgatggaaaaagtaagctctctatccactgctacgctatcgatgaattcagaattgattcctgaaaagcactgtgttatatttatcttaaacgatggttccgctaagaaagttaatgtaaatggttgctttaatgcagattctattaagaaaaggctaatcagaagattgccacatgaattattagccacaaactccaatggagaagtaactaaaatggttcaagattatgatgtgtttgtcttagattataccaagaacgtactgcatttgctatatgacgtggaattagtcactatttgccacgcaaatgatcgtgttgagaaaaataggctaatttttgtttccaaagaccaaacaccaagtgataaagctatatccacatccaaaaaactatatctaagaacgttgagtgcattgagccaggttgggccatcctcgtcaaatttgttggcacagaacaaggggatttcgcataacaatgctgaagggaaactccggatcgacaacacagaaaaggacagaattagacagatttttaatcagaggcctcctagcgaatttatttctaccaatttggccggatattttcctcatacagacatgaagcggttgcaaaagacgatgagagagtcatttcgccattcagcaaggctaagcattgctcaaagaagacctttaagtgcagaatcaaataatatcggtgacatactattgaaacactcaaacgctgttgatatggccctgttacaaggattagatcagacaagattaagcagtaaacttgacacaactaaaattccgaagcttgcccataaaaggccagaagataatgatgccatatctaaccagttagaactattaagtgtagagtctggtgaagaagaagatcacgatttctttggggaggacagtgacattgtttcattaccgacgaagattgccacgcccaagaattggttaaaaggtgcttgcattggatcaggcagttttgggagtgtttacttgggcatgaatgcccacactggtgaactaatggcagtaaagcaagtggagataaaaaataataacattggtgtttccacagacaacaataaacaagccaattctgatgagaataatgagcaggaggaacaacaagagaaaatagaagatgttggggcggtaagtcatccaaaaaccaatcaaaatattcacagaaagatggttgatgctttacagcatgaaatgaatttattgaaggagttacatcatgagaacattgttacttattatggtgcttctcaagaaggcggaaatttaaatatttttcttgaatacgttcctgggggttcggtttcctccatgctgaataattacggaccatttgaggaatcactgattactaatttcactaggcaaatactgattggggttgcgtatttgcataagaagaacattattcacagagatatcaagggtgcaaatattttgattgatatcaaaggttgcgtaaaaattactgattttggtatttcaaaaaaattatcacctttgaataaaaaacaaaataagagagcttctttgcaaggttccgtattctggatgtcaccagaggtggtcaaacagagcgctactactgctaaagcggatatatggtctacaggatgtgttgtcattgaaatgtttaccggtaagcatcctttcccagatttttctcaaatgcaagcgatcttcaaaataggcacaaacacgacccccgagataccttcctgggctacgtcagaaggaaagaatttcttaagaaaggcatttgagttggattatcaatacaggcctagtgcccttgaattgctgcagcatccatggctggatgcgcacataatttgaaaaagggctacttattaattctttttatggcactaaagtgctctggccgattttttatcaaataatacatatatatcatatttagtgacatttattgaatatatctgctatttaccggtttttttttttcaattacgctgattaagtaatcataaatcacaattgtgaaaaaaagaccaaactagatgacggtatttgattctcatacccctggaataaaatcaagtaagataattctgataaaaaaatccgactgcacagatggaagcacgaagaaacaggcctttctttgcgaggtgatatcaaaccattgatatcttctcaataacctgctctaggaaaaggaggtagatagacaaaagcaaggaaataatccatagagtttcattcacatgaataatctgttaccaatttttctcataagataaagccatctatcaaaaatgatattgaaatatttgaaaaatgcttgtttttatggggaccacaattcgcctgtacctctagaagcgtaaactgttttattgaagttagtcctgataatttctctaccgttttcgctttcttccttagtgccattttttagcatcatattattgaatttttcactttctctaaatgatttatcattcatgtccttggacaagattgaatctacatcaacaattgaacaggaaggaatattgcattgcatggccatttcccggatttgaggatcttcactaattaaaaaccaatgtagcccctcatttccttctaggtagcatttgtaaatacaacttttcaacaaattctttaatctcttaggcaattttgcaatattcatctttccagaactatcattatgttccattacatctgaccataaaataatgtctaaaacttcgggaaattcgataaaaactttcaaattagcaaatttagaatcatctaatctatcgataaacttcaaggattctcgagctgcaaaacttttacgcctttgttgaaggaaatccaa

SEQ ID NO: 112 - protein, 717 aa, Saccharomyces cerevisiae; identical to SEQ ID NO: 84

SEQ ID NO: 113 - DNA, 3083 bp, Saccharomyces cerevisiae
atgcactcaaaaaccttcttagttacaggaaaagataacgatacgataagaaaagcctttgaactgcctatcctgcaccctaacacagatctaactcactattcgggtaaggaagtgtcatgcatgtctgcaaagggactagagaaagttacatgattacataagcaaaaaatcggaattacagacacaccattttttatcctgcggccccatttccgtcttcgagggaaaggatcaaaggcgcttagcccaatcttgatgattcaccggggaagaaaggaattacagaacccccagccacgtaacacagccaattagttttctatatcgggaaacgtgattgattgcgcaattttggctgcatcagaatacatcgatgagatctagagcaccctttgatggtttaagtccggtttaaagttagtagatcaatgatttcgtagtgcattttaaagggagcgcttatccatgggtgattgcgtttacaacgttttgtgtgtactcataatagccaatctaaaattaaacaacaacaacaacgcacaattaatatgtatcagccccaatacctttttctcttactgtaatttactactaaattggggtcggacgtttttgatcttgttccttgcctgttgtttaccttgtatattacttttcctcttttatgtatttaaggtaaattaattatcttttgatcttaatatttttctcaaaatgcttcccttgtagttcggtatttttgcttcttcagatatttaaactaccgtataccataactgtttcgtgaagtagatacaaacatcgactatcctattacgatttattttacattatcatattataaatcgaccagtagtattgttaaagattaaaagcataatatactactgtcattagtcacctacagagaaacaaattcctactggcacccattactggtgaaaaaggaaaaaaataataaaagaaaagcttttctattcctctccccacaaacaaaatgcaagcggatatgcatggaaaacttcacgctgccttagaagatggtttcttcctctttccttttgaacagcaacaacaacctaacatttattatgacacaaccaccgatcaagaagaccgtccttgtttttcttttggatctacaatttcccctagaagttggcattttgaaaagtctgacaaaattgcctcatctcagctgcagaacttggttcatacacaaccaattcatttaattaatcctcaaatattgttcaatgaagagtttctgaatttggaaaatattgattctcagcctatttccaaggaaacgaaaactacgaaggactgcacaatggcaactggtcctgaaagaggaaaaaagagctctgaaagtaccagatcctcttcattatcatctcttttttctaatgatgaatccgcatctacgttccactcatcattcaataaccatgataactttcaaaagagcaacagaaatggagatgatatcgatattagtgacacaataaaatatgaaactaatacaaatgcacaaaaagatatcaaaatattccaagaaaattttgaattcaatgaattcccatacacacaagacttctacccatataccactaattatacctattcaaaacccacaaatattcatgaatcaataaattcaaaaaacacggattcatactcccaatatcaagatcagtttccaccacatactgataacatacattcctttaataatcgtcactatagcaaccataaaagcactaattgtaattactataataataccagcaataataacaacgcctccgataatgtatatgaggcagatccatttatagatgaacctcaggtgccctcctactattacccattagaaattgccttcgacgttgaaaaatcaccaccgccatcactacaaaaattaaattcaaaagagttagaattcctaaaaaagttgaactccaaactgtcaagatatgctgcggcttactccttcagcagttctaatgatcaagattattatgacaaggtcaggtttcaagaaatatcctacaagtttagtaaaacctattcttaattctcgaaaagtactacaatcttcccccttccctcaaaatatccattcacactcatttctttatttccattgtctcactcaaattgctaagaatttgtgtatttgcatatatatacactatatataggtatatatatgtattcaatgtctcaagctccatgacataataccgtagcgttattagccttatcgtatgtcgcgatgggaaaggagattcgttttaatcttgaaaaaccttcgtagcgaataatgcgacataaatcttgagagagtacatcaccaaattcactttgttaaaccgcaccatcgtgctttgcattcttattccttttgcctacactaaaattattagcatttctctaaatgagctccagtgaagacgaagacgacaagttcttgtatggttccgattccgaattagcactaccttcatctaaacgatcaagagatgatgacgcagacgcaggtgcgtccagtaatcctgatatagttaagaaacaaaaattcgactctcccgtggaagaaattccagctactgccagagatgatcgttctgatgaagatatctactctgactcctcagatgacgatagtgattctgacctagaggttatcataagtctgggtcctgaccctactaggttagatgcaaaactactcgattcttattctaccgcagcgacatcttcaagcaaagacgtaattagcgtagctacagatgtatccaataccatcacaaagacatcagatgaaagactaataacagaaggagaagcaaatcaaggtgtaacggcaacgaccgtaaaagctacagagagcgatggaaatgtaccgaaagcaatgactggttctatagacctggataaagagggaatctttgatagtgttggcataacgacaatagatcctgaagtattaaaggagaaaccctggaggcaaccgggggccaacttaagtgattatttcaattacggttttaacgaatttacctggatggagt

SEQ ID NO: 114 - protein, 360 aa, Saccharomyces cerevisiae; identical to SEQ ID NO: 2

SEQ ID NO: 115 - DNA, 3938 bp, Saccharomyces cerevisiae
cccaatgccccactttttctcgaggagttgaaacaagcgggacaactgctacgtcataggaatgggagtaccaagggaggagcctaagccgggtaaaatttggcgctgtttttcttaatctaaaaatagttcaacaaaaaaatttgggctccgcccatccagaccaaagcaatcttcggccttaacaagccaaagggaacgaaacccagactctaccatgcatttcgaacatcttgtagctaactacactggtaacccagatacctattctctcagtagctgtttcaccaagactccgcactcatggtaagtagaaaaagaaaactctcacaaaaatctgagtggcacagcttttccaaatacgctttttaaacttggagaaataaagatgtattacccgctggtgccttaaaatatccttttctccggttgtccaataatttatgttacggcggctatttgagtttttgtggaaatctctatcattaataaatgtcagccttgtgtcttaaatgcaattcaacagggaaaaggcgcgagacttcggcggcaaaaagccacagacaagtgctggttgcaaagaggtaaagaagtaatgagtgtaatcaaatagatatattaaggtagcaactcaccggtctgtccattttcttttcctgaataacttcttctgtcttcacacattcatttcatttttattttccaatatcactcaacgagaaagaagttacaagatctatctttcaaaatagtttacagttacctttactttaccctttcccttttcagtttgttaccccttctcctaaaagttttattttttgggtaaagatataaaggacactccagtcggttaaggtggctgtctagagaatataaacctgtatttatttaccaggcttatcagaaaagttaatcgtgttcttaaatatttattgaaaaggaacgtgatacagacgtaataaaagaagagtactaagcttaacttaataggtcatttatggttgaaaaacgtagtagacagagttccagtagtggctcagagttcagtgttccacctgatgtcgataacccgccactttctatccctttgaagactttatcagacagatatcagctgatcgaaaaactaggtgcaggatcatttggttgtgtaactttagccaaagcgcaatttcctttatcgaacatattgggtaaacaacatgatataaggggtactttaatggatcagcctaaaaatggtcaccaaaactatataacaaagacacaaggtgtagtggctataaagacaatgatgacaaaactgcatacactccaggattatacgagggtcagagaaattaagttcatactggcaatcccagcgaatgaccatctgatacaaatttttgaggtctttattgactctgaaaattaccaattacatatcgtaatggaatgtatggagcaaaacctatatcaaatgatgaaacatagaaggcgccgagttttttcgattccttctttgaaatctattctatcgcagatactggctgggttaaaacacatccacgaacataatttcttccacagagatttaaaacctgaaaatattcttatcacaccaagtacccagtattttgaaaaggagtacatgaaccagattggatatcaagataactatgtcattaaactggcagattttggtttggcacgccatgttgaaaataaaaacccgtatacggcctacgtttccacaagatggtatagatcgcctgaaatattattaagaagtggttactattccaaacctttggatatttgggcattcgggtgcgtggcggtggaagttactgtattcagagctctcttccccggtgctaacgaaatcgatcagatatggaaaattttagaagttcttggtacacctatcaaacgttctgattttgttaatacaaaccacatcacagctccaccacctggtggattttgggatgatgccagcaatttggtccataaattaaacttgaaattgccttatgtagaaggttcatcgttggatcatctactttctagctcccaactatccgatttatctgaggttgtcaaaaagtgtttaagatgggatcctaatgaaagggcaacagcccaagagctttgtgaaatgccattttttgaaaacaccgtggcatcccaagtagacgcaagaggcaatgtgactaatacagaacaagcattgatttttgcaggtataaatccagtagcgaccaacacaaagcccatatattttaactcttcaacaaaattgcccgcagaaacagagtctaatgatattgatatcagcaacaacgatcacgattctcatgctatgtgctcaccaacattaaatcaagaaaaactaactttggtagaatttttaaacgaattcgttgaagaagataatgatgatcactcaatacctgatgttggaacagattctaccatttcagattctattgatgagactgaattatcaaaagaaattcgtaataatttggccctttgtcaactaccagatgaagaagtcttagatcattcattatcgaatattaggcagttgacaaatgatattgaaattataaataaagatgaagcagacaacatggaacagctattttttgacctggaaattcctgaaaaggatgagtttcagagaaaacaaccatttaatgaacatgcagatattgatgaagacatcgttctaccatatgtgaacaactcaaattacacacatacagataggtcacatcatagaggtgataatgttttgggtgatgcctctttaggcgattcgtttaattcaatgccagattttactccaagaaatttcttgatacctacattaaaaaaatcacgggaaaagttcgagcctcatctatccaatccaaaccaacattttggaaatgtaaccttctaataatttgtcatttgactgacgaatcgttaggcacagttatatagttatatacacatagacatacatatgttcgcatatatattatattactatgcattcacctaaatagctactgctctattaatacagtgcttttttgatggctttaatttaacttattagacattactttgcgtttattcccctccaatatatttttatgtttgtttttcttgaacattttatgatttcttgctcttggcggctactgattttgttaagcaactcatcaagaggtcaaaaaaagtagaacgagatctttgtgttcggttacccggctcagatcctaacttggtatgtttattcgtataagttactgttgtccacaggcaatactctgcagaaaattaaaacggcattaatgctaggacaaccagaactgttactactgtatgtgcgatagttgataactgcaacattatgcccggtatattctcaaaaaaccctattactgcatacgaagaaatcgcaagagaaatctttcggtttggaaaagctcactgtgaggttccttggagccaatagtaatacagcacaatccaaggaaaaatctggcctatatgcaaggaaggagagatagtcaaaagcattctttcccctagaagttggtgcatatatggcatcgttaaaacatattacccccaaaatttcttctctaaacgatgtgcttggcctttgttttggtttttgatgtcggtcgtttgaggccccttgcggaaaatcgagatcgccgaatggcacgcgagggaagggaaataaggtttaaaggcactgaaacaataggcaagaagtaggcgagagccgacatacgagactaatgtgtccgcgtttctaaggccacttttcaatgaaacggatattgatatgctagtaaaaggacgagctcaagagcgaaaatataagtaaagaattcgagtgcacttgtctccatgcagcaagatttcatatgagtcttttttat

SEQ ID NO: 116 - protein, 645 aa, Saccharomyces cerevisiae
MVEKRSRQSSSSGSEFSVPPDVDNPPLSIPLKTLSDRYQLIEKLGAGSFGCVTLAKAQFPLSNILGKQHDIRGTLMDQPKNGHQNYITKTQGVVAIKTMMTKLHTLQDYTRVREIKFILAIPANDHLIQIFEVFIDSENYQLHIVMECMEQNLYQMMKHRRRRVFSIPSLKSILSQILAGLKHIHEHNFFHRDLKPENILITPSTQYFEKEYMNQIGYQDNYVIKLADFGLARHVENKNPYTAYVSTRWYRSPEILLRSGYYSKPLDIWAFGCVAVEVTVFRALFPGANEIDQIWKILEVLGTPIKRSDFVNTNHITAPPPGGFWDDASNLVHKLNLKLPYVEGSSLDHLLSSSQLSDLSEVVKKCLRWDPNERATAQELCEMPFFENTVASQVDARGNVTNTEQALIFAGINPVATNTKPIYFNSSTKLPAETESNDIDISNNDHDSHAMCSPTLNQEKLTLVEFLNEFVEEDNDDHSIPDVGTDSTISDSIDETELSKEIRNNLALCQLPDEEVLDHSLSNIRQLTNDIEIINKDEADNMEQLFFDLEIPEKDEFQRKQPFNEHADIDEDIVLPYVNNSNYTHTDRSHHRGDNVLGDASLGDSFNSMPDFTPRNFLIPTLKKSREKFEPHLSNPNQHFGNVTF

SEQ ID NO: 117 - DNA, 3884 bp, Saccharomyces cerevisiae
atattgttttttccctagctgttttcggtttggttatgaacgcattgtctgcgaaaagaaacgtggataagtattatagaaacagcacttcttcggccaacaatatcacgcaaattgagcaagatagtgctataaaaggtcttttgcccttttttgcctattatgcaagcattgctttactagtgtggatgcaaccaagctttattacactctctttcatcctttccgttggtttcacgggagcatttaccgtcggaagaataatcgtttgccatttaactaagcagagctttcccatgttcaatgcacccatgttaattcctttgtgccagatagtattgtacaaaatatgtctatccctttggggaattgagtctaataaaatcgtctttgccctatcttggcttgggttcggtctctcactaggtgttcacattatgtttatgaatgacattatccatgaatttactgagtacctggacgtttatgctttatccatcaagcgctccaagctgacataaatcgcactttgtatctacttttttttattcgaaaacaaggcacaacaatgaatctatcgccctgtgagattttcaatctcaagtttgtgtaatagatagcgttatattatagaactataaaggtccttgaatatacatagtgtttcattcctattactgtatatgtgactttacattgttacttccgcggctatttgacgttttttgcttcaggtgcggcttggagggcaaagtgtcagaaaatcggccaggccgtatgacacaaaagagtagaaaacgagatctcaaatatctcgaggcctgtcctctatacaaccgcccagctctctgacaaagctccagaacggttgtcttttgtttcgaaaagccaaggtcccttataattgccctccattttgtgtcacctatttaagcaaaaaattgaaagtttactaacctttcattaaagagaaataacaatattataaaaagcgcttaaaatgaatgaaatggaaaacacagatccagtattacaggatgatctcgtatccaaatatgagagggaattaagcacagaacaggaagaggatacgcctgttatccttacgcagttgaatgaagatggcaccacttcgaattatttcgacaaaaggaaactaaaaattgcccctagatcaacactacagttcaaagtgggacctccatttgaattagtgagagattattgtccagtcgttgagtctcataccggaagaacactagatttacgaattattccaagaattgacagagggttcgaccatattgatgaagagtgggtaggttataaaagaaattattttaccttagtatcaacgtttgaaacggcaaattgtgatttggatacttttttaaagagcagttttgatcttctcgttgaagactcttcagtagaaagcagattaagagtgcaatatttcgctatcaaaataaaagctaagaatgacgacgacgacacggaaatcaatctcgtccagcatacagcgaaacgcgacaaaggtcctcaattttgtccttcagtatgtccgttggtgccttcccctttgccaaaacatcaaatcataagagaagcttcaaatgttcgaaatatcactaaaatgaaaaaatacgattccactttttatttgcacagagaccacgttaattatgaagaatatggagtggactctttattgttttcctatccagaagattctattcagaaagttgcccgttatgaaagagttcaatttgcttcatcaattagcgtgaagaaaccatcccaacaaaataaacactttagcttgcatgtaattttaggtgcagtggtagatccagatacctttcatggggagaatcccggaattccttatgatgaactggctttaaaaaatggatcaaaagggatgtttgtgtatttgcaagaaatgaaaacgcctcctcttattattagaggaagatcaccttctaactatgcgtcatctcagcgaataactgtgagaacaccgtcgagtgtcaattcctcacaaaacagcacaaaaagaaaaatgccatcaatggcgcagccgttaaatgaaagttgcttaaatgcaagaccttcgaaaaggcgatccaaagtggcgctaggtgcaccgaactctggggcctccatctcgcctatcaaatctcgtcaatccacaccaatggaagcttcgaaggaaaatgaggatccgttcttcaggccaaataaaagggtggagactcttgaacatatccagaacaaactgggtgctttgaaaaatcaatgtccagattcctctctgaaatatccgagttcatcttcaagaggtatggaagggtgtttagaaaaggaggatttagtttactcaagtagtttttctgttaatatgaagcaaatcgaactgaaaccggcacgctcttttgaacatgagaatattttcaaagtaggctcattagcattcaaaaaaatcaatgaattacctcatgaaaattatgatataacaatagagaagaaatcaatggaacagaattatctaagaccagagataggctcacgttctgaatgcaaaacaagctatggtaacgaactctccctttcaaatatttctttctctatactacctaactcagcagaaaattttcacttggaaactgcacttttcccagctacggaagaggatgtgccaaggacattttcaagaatattagaaacaggttcgtttcaaaattattatcaaaaaatggatgcagaaaatgcagatagggtatattcgaaaggggtcaagttgattgcaagcggtactctaccatctggtatatttaatagggaagaattgtttgaggaagatagtttctataagtattaaataaactaatgattttaaatcgttaaaaaaatatgcgaattctgtggatcgaacacaggacctccagataacttgaccgaagttttttcttcagtctggcgctctcccaactgagctaaatccgcttactatttgttatcagttcccttcatatctacatagaataggttaagtattttattagttgccagaagaactactgatagttgggaatatttggtgaataatgaagattgggtgaataatttgataattttgagattcaattgttaatcaatgttacaatattatgtatacagagtatactagaagttctcttcggagatcttgaagttcacaaaagggaatcgatatttctacataatattatcattacttcttccccatcttatatttgtcattcattattgattatgatcaatgcaataatgattggtagttgccaaacatttaatacgatcctctgtaatatttctatgaataattatcacagcaacgttcaattatcttcaattcggcttcagtactgtatgaaatactcgctaacattttctttattctataatagcacagtgacacttaaacgtcaaacgtggcgcacattaatatacgatgtatgcatttggcttgacactgctgtaataaggaacatcatcatccatcaactagtagtcacattagtagtgtattatcacatggtgtgtaagaacattacgtaaagattgaaaaaaagtcatcaaaaataaaggaagctgaaatgcaaggactagtagtgtaatagaataatattgtgtaaaagtatcgataccctttttggaattattgtatcttcgagggtggcttttaatatatttttgaaaacctaatattataacctttcacaacaacgaaatcccaactgttgtgtaataattttactcaattcttactattgctttaccaatccttgtatttgagctctcataaagttcgctgactacttctcacgactcatgtcatc

SEQ ID NO: 118 - protein, 627 aa, Saccharomyces cerevisiae; identical to SEQ ID NO: 6

SEQ ID NO: 119 - DNA, 3197 bp, Saccharomyces cerevisiae
aatgcccattatgccaataaagacttgccgctacatacggatttaccatttttagaaaatgtgccaggtttccagattctacaatctctacctgctacagaaggggaagatcccaatactagacccatgaattacttcgtggacgcattttatgctacccgtaatgttagagaatcggattttgaggcttatgaggctttacaaattgttcctgtaaattatatatatgaaaacggcgataagaggtactaccaatccaaacctttaatcgaacatcacgacattaacgaggacaatactcttctgggtaattatgaggccttgattaaatgcattaactactctccaccataccaagcacctttcactttcggaatttatgataagccctcagatctaaataataatccggacttgaatttaattacaaccccagcaaaactaacagagagatttttgtttaagtctttcattagggggttgaacttgttcgagagtcatatcaatgacttcaacaatcaatttagattgcagttgcccgaaaactgttgtgttatctttaacaacaggagaattttgcatgctaactctttaacaagctcaaaccagcaatggttaaagggttgctatttcgattctgatactttcaagagtaaattaaagttcttggaagagaagtttcctcatgacaaataacttcattttttcagcatagttatgtgattctttatatttatttattttctctctgtgtagtgacaatttttttttaatgtttcatgttaaatatatttatattaagaagccgtcagtttcctttttgtttcattgaaatcaataactaaaattaaaattataaaaggaataacgtaaaaaaaagtctactacccaaggaaaatctactttatttagtgattatattcaactaaatattattcaaataacctcacatatttgtcttcacccttaagattttacgatttactaagttcaccttctcatggctttggagggattgcggaaaaaatataaaacaaggcaggaattggtcaaagcactcactcctaaaagacgatccattcacttgaactccaatggtcactccaacggaactccctgttcaaacgcagatgttttggctcatattaagcatttcctgtcattggcggctaattcattagagcaacatcaacagcctatttcaatcgtctttcaaaacaaaaaaagaaaaggcgatacaagcagtcctgacattcacacaacattggacttccctttgaatggcccgcatctatgcactcatcagttcaagttgaaaaggtgcgcaatccttttaaacttattgaaagtcgttatggaaaaattaccgctaggtaaaaacactacagtgagagatatcttctactccaacgtggaattgtttcaaagacaagcaaacgtagtccagtggctggacgttatacgctttaatttcaagctctctccaagaaaatccttaaacattataccagctcaaaagggtttagtttattcgcctttccccattgatatttatgacaatattctgacatgtgcgaatgaaccaaagatgcaaaagcaaacaattttccctggtaagccctgtctaattccatttttccaagatgatgcggtcatcaagttagggacaacaagtatgtgtaatattgtaatagtggaaaaagaagctgtcttcaccaaattagtaaataattatcacaagttgagtacaaataccatgcttattacaggtaagggatttccagatttcttgacaaggttattcctaaaaaaactagaacaatattgctccaacttgatatcggactgttctatatttaccgatgcggacccctatggaattagcatagccctaaattatactcactcgaatgaacgcaacgcttatatttgcacgatggcaaactataaaggaattcgtattacgcaagttttggcacaaaataatgaagtgcataacaaatccattcaattattgagtttgaatcagcgcgactactccttagccaagaatttgatagcatctctgactgccaacagctgggatattgcaacttcaccattaaagaacgtcatcatagaatgtcagcgggaaatttttttccaaaagaaagctgaaatgaacgagattgatgccagaatttttaaatacaaatgaataagaatgggagctgttgctttataaaaaatgtttttcaagaattgaaaacggttacatttaaatattatataaattgaaatctttgataatgaatactagtccaaaaaaaaatacaatttcaaaaaaataaatgccatctcctagaatcgaaccagggtttcatcggccacaacgatgtgtactaaccactatactaagatggcatatgattttacaatgattcgatggtgaatgagttataagccaggtaaggattactagtcttttttcttaagtaactttttcgcttgtgatatcttgaaataccattaaacatagataagctattgaaatgtgaagaaaattcaaaaaaaaagggaacagagtcattttttgggtagaaactaagcttcaatggatgaatgtttacccaattcatgtctactaggtgttcacctcgtcatttcaacgcattcggggccacaaatagtttatcactacccaccctccaatacagcatttctaacaaataatccaacgaagcatcagcacctctatggaaaccatgcaaatctaaataaaaacacaagtacaaataaagaagaaaaactctttaattctggctctacgaaaacagcttctcaaattgctctaaacgagtcagcgaaaagttacaataccgctattacgccatcaatgacaaatactaatactaataatgtgacattacctccaactagatcacatgctaatactgtaggatcacaaagttcaattcctgcggctactaatggtgtaggttatagaaaaaccgatatcgaagatacttctcggacttttcaataccaagaaactgaatctgaaacgtcatcatcgggattaagtgacagcgaattgtccacagactacttagacatttctagcgattcgttttctatatcttcttccttatcgtcatcttctttatcttcttctccctcaagttcatcctcatcttcccctccgcaagatggcttat

SEQ ID NO: 120 - protein, 398 aa, Saccharomyces cerevisiae
MALEGLRKKYKTRQELVKALTPKRRSIHLNSNGHSNGTPCSNADVLAHIKHFLSLAANSLEQHQQPISIVFQNKKRKGDTSSPDIHTTLDFPLNGPHLCTHQFKLKRCAILLNLLKVVMEKLPLGKNTTVRDIFYSNVELFQRQANVVQWLDVIRFNFKLSPRKSLNIIPAQKGLVYSPFPIDIYDNILTCANEPKMQKQTIFPGKPCLIPFFQDDAVIKLGTTSMCNIVIVEKEAVFTKLVNNYHKLSTNTMLITGKGFPDFLTRLFLKKLEQYCSNLISDCSIFTDADPYGISIALNYTHSNERNAYICTMANYKGIRITQVLAQNNEVHNKSIQLLSLNQRDYSLAKNLIASLTANSWDIATSPLKNVIIECQREIFFQKKAEMNEIDARIFKYK

SEQ ID NO: 121 - DNA, 3194 bp, Saccharomyces cerevisiae
aaaaagccgtttgcggaaagcaatgttttgcccattcagaaacaatatctttgctgtatccctacatgtattatgccgcgttgcttgtgcaggtacggagtccctgcacgatttttcaacaaggtctagatttgctaagacgatgaggcggagcccgaaacaaacaagccaaaaaccggaatttcgcgcttggtgtgctttcgcatcttttcgtgtggtgaatgcacctggtgcacgctgcgaaggtgacgtagcaatccaaaaaagggaagtctaggcgctttcaaccgccccccaccgtgcatgcggattggttgtcacaattcgcagacatattggcaatgtttcctcccctcctgttgatgcgggtaaggggtgtctgttatgcaggaacaggaaggtaaaaattaaatgggccttaattctgtagacactctcttggggtaataaggttaaaagccattgttgaagtacggaatcatctcttcattttttcagcgcttgtaaggaattaatccccaggaaggtgccgatgtaatgagagaagtattcttgttgtatctctttggttcggagtatttccttctttcttttctttgtagtttttatgcaaatgcagggaacagagtacccggttaaggctgttagtcagccgcactctacacaaaattacttggcaaacacgttggttgggaaaagctttatacttggcggtgtagtaattgtaaaggatcaagattgtgtcatgctaatgtgccgctgtgtaacaacctttttgaagcgcgtatttaccaccggcaaaaggccattgtgtcacataaaaaaaaactcccgccaaagccaggttcattttgcataagattcaccacagtacggaaaatacgataagttaaccagtaatttgctcgctttagctactgataaaccttctctgttaacactattatttttttattactttagatttttccgtttgtgaatagccatttttagatatataatggggttcagaaaaatacttgctagcaaatcgcatcacagtcgccaccataatcagcaccataagaacctgaagttgcaaaatcatcgctatgtacttatttccaatattacaggatcccatgaaacaaaatatttatcacccttcaggatggacaattgttcaggaagcagaagacgtgataggctacatgtgaagcttaaatccttgaggaataaaatccacaaacaacttcacccaaactgtcggttcgatgacgccactaagactagtgatgataaatgcgtctcttatgaggtgcccgaaagggatggccttgctactatttcgttagaagaggtttttccaaagtccaacaggtgccaaatacctgaagaaaacttgggagaaacagatagcgttattcacagagatttgggaaattttgcaaatgagaatgactatccacagtggagaaaagttgaaagtcaatataacttagagaatgtccagcctgaggaggatgaaatagttgatagactcaggtccgagattagaagcactaaattaaaatctgtaaaaacgacaagcagaacacttgaaaaagctatagaggctcgatgtactggaaagagagttcttcaacaactaagttgtcagagcaaccaactcaccaagatcgagagcaattgtgacatgcttaaaattcaatctaacgtagccgaccgaaagattgacgaacttgcccatgaaaatagaagcctgcttgcattaaaatcacccaaccccttcaggaagaaaagggagagagaaaagcgagaccagatcaacaatttgaagttaaagcatcgtcacttacagcaagaaactatgaaaagagcccaagattctgacaaaaatttagccataaatctaagttctgaatatggacggtatggccaaggggtggaaagacagcgtattcttagagatgcccagaagtatcagtttgaagccgatgaagaagataaccaaatggaaatcgacttgtacggaaacctagaacaaataaaagcggtgagtggtgacttgaaaattatggctcacgcttttggcagagagtttgaagcacaaaacactagaatgtttgacatcgagaacaatgtacagcaggcagataatgctttacaggccaagcgatatagattggagaaagtgatcgggaaaagatggtgatctgttatacacacaaaatatcgtgtataaatatattgaataaatagtttctaaaaaggcatacgcagatattcttgcgaaagagaaaaaaaaaagagcgagggggacattagtactgaaggtctcaattcttctttgtattttctttcggagttgtcagacaaagctttctctttcccataaataaagtgcattcaaacatcggcaggtttgtttttcccagttgttacgtatttgtttcccgttccattcatgatcttaaactgggttaactgaaaaatcaacatgattttgtgaaaagtaaaagagggtaagaaagatagataccgctgtcgtgggactatattttttacagtaccaagtctacttgcttctcataaagttgataagttataattcatataatttcatttgtcaaaaaagattttagttacaaaacgatatcaaagttcaatcttgttgggaaaaaggaaaacattatgaagggtttccggtaatcactgcgtatgccacactattcctatagaattgtcttgattgggtgcttatgctgcggaaaaattatattctgcgcttgccttttatattaagcgtcacaacgcccttaccaagatcgagcggattaagacaagagtgtatctcaagcgtccgtatatgtttaagttgaaaaggatatttagtaagaataattctaccctacaaacgatattagtaaaaaaaaaatcaataatagagttattgtacaaacatgttctgaaaattggaagcatcacatcgtatgctactagagaaaatttttactatccttttttccacaagcccagccctagcccgatcatcctattaattgtcagaccaccgaatgctatcccgccacggttgatataacgaaactctttactgctttgggtcaaatatgcctcttttccgcattttttcggagtagttcattgccgcatacataccgcaacttggacgaggatgtcctccttctcttact

SEQ ID NO: 122 - protein, 397 aa, Saccharomyces cerevisiae; identical to SEQ ID NO: 66

SEQ ID NO: 123 - DNA, 3875 bp, Saccharomyces cerevisiae
ttatttcaagcatttttggtgttgttggtgcgggtatattaaccctattgaacaataatgccaataactctgctcacatcggccttttgatattacctggcgttgctttcggtggtttggcacaaagttccatgctcgcttctcaaattcagttagacaagaagagcccaacttttcgatcagattttgtctctattaccacttttaacacattttgcaaaaatctaggtcaagcactgggaggtgtcatctctaacactgttttcagtgctgctgctatcaagaaattaaccaaggctaatattcagctcccagatggtaccacggtagacaatctggtaatctataggcagaccaatttcgatggctctcattccaaattgggcaatataatttctgaatctctcactgacgtcttttacatggcattaggattttatgcattatctctcatttttgctgtttttgcttcaaataagaaagtcacagcaagcctgagataagttaagcacgatctagaaggtggcgagcctcaaagtataaagctgcagaaaaaataaacatgacttttagtaattggctgtttagcttgctgaattgtgtaccacaactaacgataacagtaagagggtaatccgagacagtatgagtacagctattaaatagttaatttagatttttatactggtatgataaacgacgttcatatagcaagagcgtcaatgcctctatgtcaccttcaatagaagtttccctttttatttcgacttttgtttttgtatttttcggcgtctgccttgttccatttttaaggcgccaaaaataaaataaaatgaagaacgattagtactcaaagaacactttaatccttggaaacaaaaaaataaaaaatcaaaagttgaaggaaggtcaaattttcttcctccaacgataataatacttgcttatataactcttttaaagttttacaaaactttggatcagaaaaaaagaaaaaaatatggctactccccatttatatcacagatataactccaaaagctctaacaaaaatatcaattctagcggaaattctacagaggttgaccgtttcattccaaaatcagtttcgagaaatgcttataagtctattccaatgttaaatgggtttgacataagttactcagaactttgcgagaaatctccttcacctgagcggctatcatcccctgaattctttaacgaactgcgaaacaccgggcattacgaatcaatcagtacaacaaatgagttttccatgtcaagtatctctagctcttctgagagtcaagttaccagaagtggaagtgcaagagcttcaagaaacgattattcaaaattaactaaagagcaaaaggaccatagaaagaatattgcacattctcttggttttcaattgcccgaccgtgtctttacgtttgagaccacaagtgctgaaattctggaaaagaataaagccatcaaaaattgctttggaccaggaagttgcgccgaaataagatcaacctttgactttagtacactctcgcccgatgttgcccgttattatatcgctaattctaacgcaagatcagcttccccacaaagacaaatccaaagacctgctaaacgagtaaagtcacatattccataccgtgtattggatgcaccttgcctgagaaatgatttttattcgaacttaatttcttggtcaagaaccacaaacaacgttttggtgggactgggttgctccgtatacatctggtctgagaaagaaggagcggtatctatattggaccatcaatacttaagtgaaaagagggatttagtgacatgcgtctcattctgtccttacaatacttattttattgttggtacaaaatttggccgtattcttctttatgatcaaaaagaattttttcattccagcaacacaaacgaaaaggaaccagtatttgttttccaaactgaatccttcaaaggaatatgttgcctagaatggttcaaaccaggtgaaatttgcaaattttatgttggagaggaaaatggcaatgtgagcctctttgaaataaagagtttgcatttccccataaaaaactggagtaaaagacaaaaactcgaagatgaaaatttaataggattgaaacttcattccacttatcaagctcaggcacagcaagtctgtggtacgttattaagagcttatgctttcacatacccttttctggtatagcgcttattttttcattatgaaaaatactaacaaatattttctacaggtatttctctgaatgaacatgcaaacctgcttgcagtcggcggcaatgataattcttgtagcttatgggatatttccgacttggataaacctattaaaaagtttgttcttccacataaagcggctgtgaaggccattgccttttgtccttggtcgaagtctttgttggctacgggtggtggaagcaaagacagatgtattaagttttggcatacatcgacaggcacattgttggatgagatttgcacctcgggacaggtgacgtctttgatatggtcgttgagacataaacagattgttgctacttttggattcggtgataccaagaatcctgtattaataacactatactcatatccaaaattatcaaaactactcgaagttaggtcgcccaaccctttgcgtgtactgagcgcagtaatctctccaagttccatggcaatttgcgttgccactaacgatgaaacgataagattttatgaactgtggaacgataaggaggaaataattaatgaaattcaagagagtgggatttatggatctaatattatagaatatatggagggtatcgaaacaacacataacaaaagaataaggtaatataaaaaaaggatattcattgcacgcacaaaccaaatacttcaaatagcaaactaacagtaagaatatataaaactatacatacgtatacataaaaaaataatagggaaaaaaaaaggaaaccatatgagtttgaatgaggcgacgtgccatattaaacaattatattttaacacttccgcactgcacctatttagttggctgatttgtgacgtttttaattccgatcggcctgaaacagcgaagggtcctggaaaattaagataataaaacgaaatgaaacccagcaacgttagatgatgctcaaaaaaatatagagacagagaaaaaccagaatacaaagagctgtttaagtggtcaatatcccaggtacaccgagcccagtcacatcgaacttataatggatgcaaagaaaaatactggtgaagccaataatgatgtattggaagaggaagcagcgattcagttgattgcaccaggtatagcgagaaacttaacacaagaagtcattaccggtatcttctgtaatgtagtaatatatcctcttcttctaatatattttgtcttaactttccgttacatgactacaaatattgtaccttatgaatttatagatgaaaagtttcacgttggccaaactttgacctatttaaaaggtaaatggactcaatgggaccctaaaataacaaccccccctggaatctatattttgggtttaattaattattattgtataaagcccatattcaagtcgtggagcacactaaccatactaagattagttaatttacttggagggattatcgttttccccattttagtactcaggccaatattcctttttaatgccttaggtttttggcccgtttcattaatgagcttcccattgatgacaacttattattacttattttacaccgatgtgtggtctacaattctgatattgcaatcactcagctgcgtgttaacattaccgtttggccccgtgaagagtatatgg

SEQ ID NO: 124 - protein, 593 aa, Saccharomyces cerevisiae; identical to SEQ ID NO: 12

SEQ ID NO: 125 - DNA, 2727 bp, Saccharomyces cerevisiae
caaaaaatgtatacaaactcttaggattggtcaagaaaagtaaatgttgtactgctccaaagatattgcgatgccgtgataattcaaaagggtcgacccagtctatttcactcgcgcgataatcgttcgttatccgaagctggccaattgatacaattaattgacatcagcagacagcaaatgcacttgatatacgcagcttaaagcaagggtaaattatctgaaaaaggattgaatacaatcaaaaccttcacatacattggtagtaatatcgagcatcgctattagcagagtatctcgaagtctaccacggcgaaagttgattttttatctgaggtgctgatcttcggacgcaatgcgcaaacgtaattccgtagttttcccaattattttattttttaaattacacgtaccaggtagatcacatacgtatacccaacacctgttatatagtgaattgaattattcggaacatcaataatcctttgcttataattcttgttatcatccatcttgcatctttatttaattatattttgcacaataagctatctatgtgagctgcgtacggtgactccaaacaatctgttaatttccatataaataacttgtagtcggatcgtacaatggctctatataggtttggaccggtatgtaacctaatatggctgactcaaaacctgctagatagttatccaagtgaatttgagtctcgtatcctttatcacatttttacaatagtggctagctatctttttcatgttaggctcacccggtattctcatgcaagatcaaacaaaaaatggtaaagttttggactttacactgcttacagttgcttttttatgaagattcaaaagattatgtcctcggcggctaaattttccattaataatattatccttttacgcgaccgaaaaagagaagcgttttaagagttgtttctaacaaacattaataataaagctaacgtgaactgaccaggctctatttgaaagatatggcaccgaaaaagaaatcaaacgatagagccattcaggcaaaaggctcagaaggttaagtatttttttacatgctcatcaaataccgccattactaacaattgtaccccgggtattttatcagctgaacaattaatagaagattacttggtgtcacaatataaaccattttctgtaaatgatatagttcagaatttgcacaataaagtgacaaaaacaacagcaaccaaagcattagaaaatctcgttaacgagaaacgcatagtgtctaaaaccttcggaaagattataatttactcttgtaatgaacaagatacagcattaccaagcaatattgatccttctcagtttgattttgaaactgtattgcaactgagaaatgatttaatagaactagagagagataaatcaatggccaaagacgctcttgactctgttactaaagaacctgaaaatgaagatctcctaacaatcattgaaaacgaagaaaacgagttgaaaaagattgaatcaaaattacaaagtctacaggatgattgggatccagcaaatgatgagattgtcaagcggataatgtctgaagatacgctgctacaaaaagaaatcacgaagagatcaaagatttgcaaaaacctaattgctacaataaaggactcagtgtgcccgaaaaatatgaatgaatttttggtatgtattttgaacatttttcgaaaccttttcttttgaatatactaacgaaatctttacaggaagaaattggatttgaggacatttgatgtgaaaagcaattggttgttccgtaccggaacacttgctattttacttatcatgattgtttttttttcttattctttgctattattatcaaattatatataggtaaataatcttacactagtttataagtgtcacgaacgatgaaatggaaacttgggggggaaggctcaaaaaacatactgtgtgtttatggggctgcctttgctagttgttgaggggtgagaaccgcaattactgacaaacgttactgatttgtaatattcaaaaactccttgcattgccttcccgttggccaaaatagtagtcgttgacaaagagtacggcgtcgattctaaagttggtgaggggatttgctcgcatatagttgtcagttcctgtgctaaaactgaagcaataacagaaaatattgaaaaacagcgaagtaactgcatcttaattgaaaatgtatgaagtaggtataatattttggcacacaagtgactgttgagagcttacaatcattctagaatgaggaatacgtcaaaatggaaacttaacatatcacctcttcttacaactatttatattgtatatttacaagggaaatcaattgcctgatattcagtatattggatctgaaggtatgaaacagtcccttaattaagctttagatgcggacagaagtttttttgttaaacttgcatgtcaaatttcaaactgcgtgtaattaccgtattcggaaattacatggtttcagtaattttgcaataaacgcagcaaccggtgatggcgaagttttaccatcaaacaataacttataataactgaatgccggcaggttgaaacaaattcttgaaaattagtcatttattctattgtgcgaatgtaatccactgaaatcatctaaagcaccattaccattgtctagcctgtgaataaaaaaatatgggagtataatgatagagaagtg

SEQ ID NO: 126 - protein, 218 aa, Saccharomyces cerevisiae; identical to SEQ ID NO: 70

SEQ ID NO: 127 - DNA, 3830 bp, Saccharomyces cerevisiae
ggctgtctttattgttcgtggtactttggttggccggcgatgtctttaaccttatgggtgccgttatgcaacatcttttgtctaccatgatcattcttgctgcttactatacggtggcagatatcattttactaggtcaatgtctatggtacgataatgaggaaaaaccagcagtagaccctattcatctctcccctgccaatccaataaacgaaaacgttctgcacgatgtgttcaatgaacaacaaccgcttttgaattcccaaggtcagccaaatcgtattgatgaagaaatggctgctccttcatccgacggaaacgttggtgatgataatctccgtgaagtcaattcaagaaatttgataaaagacatatttattgttagtggtgtagtttttgtaggtttcatctcgtggtatgtaacctactgcgtaaactacacgcaacctcctcccgtggaggatccatcactgcctgttcccgaactgcagatcaattggatggctcagatattcggttacttaagtgcccttttgtatctgggttcaagaattcctcagatattactgaattttaagagaaagtcttgtgaaggtatcagtttcctattctttttgttcgcctgtttgggtaataccacatttattttctctgtgattgtcatttctttagactggaagtatctaattatgaatgcttcctggttggttggaagcataggtactttattcatggatttcgtcatattttcccagtttttcatttacaaaagaaataaaaaatttatactgaattaacatgttctatctaatatttatttaacatatttttgacctcacaaactttttttttttttctctctgtcattgacatttttttaatgtcacaaaaagaaaaattaaatgtattataaaatttcatttaaataggaaaaaacccgtgattactaaaggcatattaaagatctattaaagatctattaaagctttctgctaccagtatggataatattttaaaggcatcaaatatggaagggacttcaacaatgacagttacctcgcgtagttctgaagactctagttgtatctcaaatcatgaacaagataccgatacacataaggacggcgacacaagtggtctggaaaacagtaaaatttcgaagagaaagtggatgaaagagtttttcaaactttccaaatctccagcttccaaaagcaaccggagtataggttccatgaaaagtaaccagagcctcgtttcaatgaaaagtagtgacgatggcaacagttataaaaatgattactcttctatctgtggtaacagccttccatctgcaggcttgagtcgttcgaatagtgtgaaagaattaaaattagattcaactggaagtcagagatcaaaaaataatgttgccatgttagcacgttcttctacaacatctcagacaacgtgctcttcttcttcatcatcatcttcttataactctataaaaggaaatgaaaatgatattttattgcagaataacaatcactttaggcataacaaagaaattcctcaaagtaaagggagctccaacattaacaccgcatcgattatgagccaatacaatgtcgatacgcaagcaaccgctataatgagcgatatgcaaaagcaatacgactcgcaacagatgacatcaccatttgtaaacgaagacttgcatttcgatccaaatggtgaagtttcacacgtaataaaagcaatttttaaagaaattggttataaatacgatgatttcagtgatattcctgtttttcaattaatgcaagaaatgtatcaactagtgaagaagaattccagcgctagaagaacaaagataacagactatgcctctaaacttaaagaaaaagaaacgcaactaaaaagtcaaaatgacaaaattttgaagttagaaacaacaaacaaggcctacaaaactaaatacaaggaggtctctctggaaaataagaaaataaaagaggctttcaaagaactagacaatgagtcatacaatcacgatgaggaattactaaaaaaatacaaatatactagggaaaccttagatagggtcaatagagaacagcaattaatcattgatcaaaacgagtttttgaagaaaagtgtcaatgaactacaaaatgaggttaatgctaccaacttcaagttctctttatttaaagaaaaatatgcaaaattagctgatagcatcactgaattgaatacctctacgaaaaaaagagaggccctgggagaaaacttaacttttgaatgcaatgaattaaaagaaatatgtttgaaatacaaaaaaaacatcgaaaatatatcaaataccaataagaatttacaaaattcgttcaaaaatgaaaggaaaaaagttttagatttgagaaatgagagaaatttgttgaaaaaggaaatactgttgattgaatgtcatggttcatattctctactccttgtatctaatattctgacatgttatcggttcttactgccaagtgatactattattgaaactgaaagcttaattaaggagctactcaacatgaataattcactttcgaaccatgtgtcttcttctgacgagcctccagcggagtactcgaaaagattagaattaaaatgtgtagagtttgaggaaaagttactttatttctatcaagaacttgtgacgaagaaaattatagacgtcatttacaagtgctttattaattattacaagaaaagtaggcaaactgaccaaaaatccaatcagaactccagcactccgtataaacaaagccaaagacaagttccgcactccatcaagtgaacctcaacagctacacattcttttataatccttaatattctatatacatatatgaaaaaatagaaaacgcgaaaacttgtcattttttttttaggcgtttttataatatactgaaaataaaaagaggctctttaaatgttgacactctactccaatatcaactgtaaaaaatctctttatctgctgacctaacatcaaaatcctcagattaaaagtatgtcctccactaggccagagctaaaattctctgatgtatcagaggagagaaacttctataagaagtatacagggttgccgaagaaaccattaaaaaccattagattagtggataaaggcgactattacacagttataggttcagatgcgatatttgttgcagattcagtctatcatactcaatctgttttaaagaactgtcaattggaccctgtaacggcaaagaacttccatgaaccaactaaatatgttactgtttcgctacaagttcttgccactctgctgaagttatgtttgttggatctgggatataaagttgagatatacgataagggttggaaattaataaaaagcgcatctccagggaacattgagcaagttaatgagctaatgaatatgaatattgattcgagtatcatcattgcaagtttgaaagttcaatggaattcccaagatggaaactgcattattggagttgctttcattgataccactgcatacaaggtgggcatgcttgatattgtcgataatgaagtgtattccaacctagagagtttcttgattcaattgggtgtaaaggaatgtttggtgcaggacttgacatcaaattcaaactccaatgctgaaatgcagaaagtaataaatgtaattgatcgctgtgggtgcgtcgttacattattgaaaaactcagaattttctgaaaaagatgtcgaactggatttaaccaagttactgggcgatgatttggcattatcgttaccacaaaaatactctaaactatcta

SEQ ID NO: 128 - protein, 609 aa, Saccharomyces cerevisiae
MDNILKASNMEGTSTMTVTSRSSEDSSCISNHEQDTDTHKDGDTSGLENSKISKRKWMKEFFKLSKSPASKSNRSIGSMKSNQSLVSMKSSDDGNSYKNDYSSICGNSLPSAGLSRSNSVKELKLDSTGSQRSKNNVAMLARSSTTSQTTCSSSSSSSSYNSIKGNENDILLQNNNHFRHNKEIPQSKGSSNINTASIMSQYNVDTQATAIMSDMQKQYDSQQMTSPFVNEDLHFDPNGEVSHVIKAIFKEIGYKYDDFSDIPVFQLMQEMYQLVKKNSSARRTKITDYASKLKEKETQLKSQNDKILKLETTNKAYKTKYKEVSLENKKIKEAFKELDNESYNHDEELLKKYKYTRETLDRVNREQQLIIDQNEFLKKSVNELQNEVNATNFKFSLFKEKYAKLADSITELNTSTKKREALGENLTFECNELKEICLKYKKNIENISNTNKNLQNSFKNERKKVLDLRNERNLLKKEILLIECHGSYSLLLVSNILTCYRFLLPSDTIIETESLIKELLNMNNSLSNHVSSSDEPPAEYSKRLELKCVEFEEKLLYFYQELVTKKIIDVIYKCFINYYKKSRQTDQKSNQNSSTPYKQSQRQVPHSIK

SEQ ID NO: 129 - DNA, 4754 bp, Saccharomyces cerevisiae
ttcaaagcagtttgtgcaatttgtccagcagttctgtatttgttcaagaccgattcctgtagaatatttttgtcctttagcaaaatctgagtatcctcgtgggagatagctagagccatgatagttttagcaatattagtcgggtcgggttttttcttaaaagtattttgaataacacgatgctttagctcatctcatctcttctgctgaaatttttctttacttcggtaaaattttttcagaaagcaaaaaaagcttcacagaggcatgaccctctccgggtaaaaaaaagcttagggttaccggcctgtcatttttagggcattatcaatttttgccatctagttgcaactataataatacagtatgaattgcacgaaagagcagtcaatgtaaattcacgaagtgactgacagaatactgacatcagctgatttctcatagagctgtttctctgataacacgttgtttgaacatcgacaagatgaaaatctagaagtatcaagtttcctttaaagggatatataacagattctaaaactgacagaaatatttcgagtgaagaagaagcgttaaatattggatctttccgcagttctactctgatacatttttgaagtaggagagtcatttagaaggcgtattgctcaatagtagaaagcaggcctgtgcacatgaattaattaaaaaatataaaggtagtgattagacgacacatgtccataggtaacctgtcataattttgaacaatttcccttcttttcttttttttttttgggtgcggcgatatgtagcttgttaatttacacatcatgtacttttctgcatcaaaatatgaaaggcgatagtagctaaagaaaataccgagaatttcctcgaaaagttgacgacaaaagaaaggcataaaaaagtaatttgaaaatattttaaaactgttttaacccatctagcatccgcgctaaaaaaggaagatacaggatacagcggaaacaacttttaaatgatggaaactcctacagacaatatagtttccccttttcacaattttggtagctcgacacaatatagtggtaccttgtcgagaactcccaaccaaataatagagctagagaagcccagtactctatccccattgtcaagaggaaaaaaatggacggaaaagttagccaggttccaaagaagtagtgctaaaaagaaaagattctcaccttctcctatttcctcctctacattttcgttctcacccaaatctagggtcacttcttcaaactcttctggcaatgaagacggtaacctaatgaatacaccttctacggtttccactgattatttgccacaacaccctcacagaacatcgtctttgccaagacctaattccaatctctttcacgcaagtaatagtaacctatcccgagcaaatgagcccccaagggccgaaaatttatcagataatataccacccaaggtcgctccatttggctatccaatacaaagaacctctattaaaaaatcctttttgaatgcttcttgtacgttatgtgacgagcctatttctaacagaagaaagggagagaaaattatagagcttgcatgtggccacttaagtcaccaagaatgtcttattatctcttttggcaccacttcaaaggcagacgttcgtgcgctatttcctttttgtaccaaatgtaaaaaagatactaacaaagccgttcaatgcattccagaaaatgatgaactaaaggatattctaatttctgattttttgattcataagattcctgattctgagttatcaatcacacctcagtcccgctttcctccttattcaccactcttgcctccttttgggttatcctatacacctgttgaaagacaaacgatatattctcaagctccaagtctaaacccaaatctcatattggctgcaccccccaaggaaagaaaccaaattccacaaaaaaaatcaaactatacatttttacattcacccctggggcacagaagaattccgtccggagcaaactctatcttagcagacacctctgtagcgttgtcagctaatgattctatttctgctgtttccaattcggtaagagcaaaggatgacgaaaccaaaacaacgttgccgctgttaaggtcatattttattcaaattcttttgaacaatttccaggaagaattgcaggattggagaatagacggggactatggattactaaggttggtagacaaattgatgatttccaaagatggtcagagatatatacaatgctggtgtttcttatttgaagacgcatttgtaatagcagaagtggataacgatgttgatgttttggaaattagactaaagaatttagaagtatttacacctattgccaacttgagaatgactacactcgaagcttcagtactcaaatgcaccttaaataaacaacattgcgccgatttatcagatctttacattgttcagaatataaattctgacgaaagcacaactgtacagaaatggatatcaggtatattgaatcaggattttgtattcaatgaggacaatatcacttcgaccctgcctattcttcccattataaagaacttttcaaaagatgttggtaatggtaggcacgagacgagtacctttctaggtttaatcaatcctaacaaagttgttgaagttggaaatgtgcacgataatgatactgtaatcataaggaggggattcaccttaaattcaggagaatgttctaggcagagtactgtcgacagtatacaatctgttctaaccacgataagctcaattctttcccttaaacgagaaaaacctgataatttggcaataatcttacagatcgattttacgaaattgaaggaagaagacagtttaattgttgtttataacagtctaaaagctttaaccattaaatttgcgcgtttgcagttttgtttcgttgatcgaaataattatgttctggactatggatcggtattacacaagatagattcactagattccatctcaaatctcaaatcaaagagttcctcgacacaattttcacctatttggttgaaaaatactctatatcccgaaaatattcatgaacatttgggtattgttgctgtatcaaatagtaatatggaagcaaaaaaatccatactatttcaagattacagatgctttacaagttttggaagaagaaggcccaatgaattgaagattaaggtgggctatttgaacgttgactacagtgataaaattgatgaactagtcgaggccagctcctggacttttgttttagaaactctttgctacagtttcggtctaagttttgatgaacatgatgacgatgacgaagaggataatgatgattcgaccgataatgaacttgataatagttcaggatcactgtcggatgctgaatctacaactactattcatattgattctccatttgataatgaaaatgctaccgcaaatatggtgaatgacagaaaccttctcactgagggtgaacatagcaatatagaaaacttagaaactgtcgcttcttcagtacagccagctctgattcctaatattagattttcacttcattctgaggaggaaggtactaatgaaaatgaaaatgaaaatgatatgccagtattattacttagtgatatggataaaggaatcgatggcataaccagacgcagttcattctcgagtcttatagagagcggtaataacaactgtcccctccatatggattatatatagagtatacactaaattttatgcaataataaaaagaaagcatcccgccaaacgtttcgtaactacatattgttacatagtttgattccgtgaatttgaagtggacgcagttcttcttagtctttcaagttcatagtaaatagacattacccaaagatctctttcctgtcttgatcttgccatgaaaaccattgacttgccgctcacacctaactttttagtgaaatggatcttatctgtgttacttggaacattagagttattcaagtcagcttccggagcagaaggtgggtcaatattattatcttgtctaccataatcttgcgtatattgcttttcattccctttcttctgtaagcgattgctagaaagggcacgccttgttccaaaccaaagcgtaaagcatcgcgaactctcgtcttctacagatcgccatccgtccccataaactcgtgggagagcgtgggatccatagtttatttcgtcaaaagtacgatctctctgcagaaggtctagttctgttgtggtcccagagtataggtagcaatcgtcaatcggaatggttacataatgagcatactccaaaacttccttagcaaaacctgtggttgatctatgaaagcagtggaacagtacaataaaacctgatatcaaaacgacgtagtacttcgagaaaacagaatgcttgtgcggcttttgatataaaggtcccttttgaattaacggcctacttaatgatattccatttgcattaaaggtttgctcatctgcacgcccatgttctacgatccagcgcaatgtattctcaccaatttttgtttcctcttctccatttagcatcaaaagacctgcatttgaacgccttatttttaaaagcctctccgtatcttccctttgcttgtttttccaataggatatcatttgtttcagctttatgacccactcttcagcaactgttgctgatgtagcaagcagcttcaagaggagtccatttgaggtttct

SEQ ID NO: 130 - protein, 917 aa, Saccharomyces cerevisiae
MMETPTDNIVSPFHNFGSSTQYSGTLSRTPNQIIELEKPSTLSPLSRGKKWTEKLARFQRSSAKKKRFSPSPISSSTFSFSPKSRVTSSNSSGNEDGNLMNTPSTVSTDYLPQHPHRTSSLPRPNSNLFHASNSNLSRANEPPRAENLSDNIPPKVAPFGYPIQRTSIKKSFLNASCTLCDEPISNRRKGEKIIELACGHLSHQECLIISFGTTSKADVRALFPFCTKCKKDTNKAVQCIPENDELKDILISDFLIHKIPDSELSITPQSRFPPYSPLLPPFGLSYTPVERQTIYSQAPSLNPNLILAAPPKERNQIPQKKSNYTFLHSPLGHRRIPSGANSILADTSVALSANDSISAVSNSVRAKDDETKTTLPLLRSYFIQILLNNFQEELQDWRIDGDYGLLRLVDKLMISKDGQRYIQCWCFLFEDAFVIAEVDNDVDVLEIRLKNLEVFTPIANLRMTTLEASVLKCTLNKQHCADLSDLYIVQNINSDESTTVQKWISGILNQDFVFNEDNITSTLPILPIIKNFSKDVGNGRHETSTFLGLINPNKVVEVGNVHDNDTVIIRRGFTLNSGECSRQSTVDSIQSVLTTISSILSLKREKPDNLAIILQIDFTKLKEEDSLIVVYNSLKALTIKFARLQFCFVDRNNYVLDYGSVLHKIDSLDSISNLKSKSSSTQFSPIWLKNTLYPENIHEHLGIVAVSNSNMEAKKSILFQDYRCFTSFGRRRPNELKIKVGYLNVDYSDKIDELVEASSWTFVLETLCYSFGLSFDEHDDDDEEDNDDSTDNELDNSSGSLSDAESTTTIHIDSPFDNENATANMVNDRNLLTEGEHSNIENLETVASSVQPALIPNIRFSLHSEEEGTNENENENDMPVLLLSDMDKGIDGITRRSSFSSLIESGNNNCPLHMDYI

SEQ ID NO: 131 - DNA, 3272 bp, Saccharomyces cerevisiae; identical to SEQ ID NO: 75

SEQ ID NO: 132 - protein, 423 aa, Saccharomyces cerevisiae; identical to SEQ ID NO: 20

SEQ ID NO: 133 - DNA, 2333 bp, Saccharomyces cerevisiae
atattatatatatatatagggtcgtatatatatcgtgcgtcttcttccttctctaagggtaaaattccttgtatttgttataatagtagtaactgccgagcccacccaaagctgtcaaaacgacagggacaggtttagtgaacctggaaggcatgcctcttatgacaccagcaccaagtagtaaggtcgatgcacccaatgccatttcgagcccaccatctctattcatatgtagcaagtaaccggcaatcccatatacactaccgaatactaagccagatactagagatggaatggagcccttacggtagtatcccataaggccaccggctgtagtcaaaagactcaatgtatatgctggatgttccatagtgtgatctgatgttcctttctctcaaacttcgtttctgtcttgtctcccgctgttacctaataacttcatgtgatctgctcccccttctcgttaaataccaccttttcatcaaccccgtagggcgcgacacgtctaaaatattaacctctgaatacttattgggtcaaaatgaatgttgataactttcctttacaaaaaaagggctaatagagtatatgcatttcggtagtgaaatattcgttaatgctaatatgctcagtagtgatcctagattaccagttttactgcagccatcgtacaattttggaacgagtataaagagagaaattaaaaacgacaagaaatattcgtactagcttctcttccggcttgatgacagtcttaatatcatctgcaactcttgaaatcttgctttatagtcaaaatttacgtacgcttttcactatataatatgatttgtcaatgtgatgagtgaatgtctccctgttacccggttttcatgttgatttttgtttcaggctctaaatgtttgatgcaatatttaacaaggagaacagaaatgttttgtgacagcacctgtcaattttaggatagtagcaatcgcaaacgttctcaataattctaagaatgacatcagttcaaaactctccacgcttacaacaacctcaggaacagcaacagcaacagcaacagctttccttaaagataaaacaattgaagttaaaaagaatcaacgaacttaacaataaactgaggaaagaactcagccgtgaaagaattactgcttcaaatgcatgtcttacaataataaactatacctcgaatacaaaagattatacattaccagaactatggggctaccccgtagcaggatcaaatcattttatagagggtttgaaaaatgctcaaaaaaatagccaaatgtcaaactcaaatagtgtttgttgtacgcttatgtaatgatagtaatagaatccaaaaaaaaaaaaaatatacatgctttttcatatcctctctcaccctatctttttttttcttctaattttggctccgttcatatcttattcaaaattaattcagcggtaatcttatctttattgttagacttcgcagaaatttcctttagcttcgatgcagatagtttgatcaagtcattttgtttattacgtcccagttcgcgagaaataatgttaaccaatgcccacccttttaggtatagttcgctaagttcaacgctcctcaaagcattctttaatgccttttccaagagctcgatcttggtttgtttcttgctacgtagagcctcataatacagagtctcacttagcctaccaaaacaagcgtaattgaatggtgtaatacataggacctgttccaaacaataacgggctttttcaaattggcccatttcgaaataaatctcgctggcataccaccacaattctgcatcaagcgggaatttatctgtaagagccaccacttctttaagaatactttcttggctcaaattcttggaagttgtcttaatagctatcaatttctttgcaatagagacataagtaacgaagtccgtttcatactccagatcatcattcaacaaattttccagatattcaatagcgcctttatcatttccgtttatctgcaataaagtggctttcatgattaccattttatacgaattttcaccaagacgatctcttaatgtattataaacaacttgcgcatcaacgtcttggtttcggtacaccaaaacatagaaaagcatttccatcaagaagaaatagtttccttctgttagtgcagagtctccgcttttcatgtaaattttcatttcattttctagttgcagtaattgttctggattaaattgagtatacgctttggtattcataattgtcaagagcttttctctaaccaaatccttcaacattgttttatctactgctttctataattt

SEQ ID NO: 134 - protein, 110 aa, Saccharomyces cerevisiae; identical to SEQ ID NO: 22

SEQ ID NO: 135 - DNA, 4067 bp, Saccharomyces cerevisiae
cctcagatgcgcaattcatggaattgtactcttgccagaagttaagtggttcgatagtcactccattggacgtagaaaactctttattacagaagttgtccgcaaagagtttgaagatatccctaacaaagcggaacaagttccagttccgccatcgagaaatcgtcaagagtatgcaaggagtttatcacaaccatcacaactccgttaatcaagagcaggtcttgaacgttttgttcgagaatagcaagcaagttcttttaggtttaaaagatatgttgaaaagcgacgggcaacccacttacttacatctgaaaattgcaagttacattctttgtataacgaacgttaaggaacccataaagctaaagacatttgttgaaaacgaatgtaaagaattggtccagtttgcacaagacaccctgaagaacttcgttcagtaatcactttcaagctgtagtatgtaaacgatatagatgaagttttcgtgtgtataaatatatgaactctagagtgttgcataatttgaaacacagcatttcttttcggagagctcgtttcaaaatgaaacaaacgccgttgtccgttttcgtctcaatagaaaaagtgaaacagataaaaattgttttaaaagaaacgaatttgcaacatcttaagatatatcaaaactaatacaaaacagcctaaaaaagattgaacaactcttcgcggtcaggtctcgacaccataaatcgaagtactcgtacgctagttttctcgcacatagtaccactacgttccttttacaattagattacttctttttagttgacttttttgagacgttcgtgccattcataaaataggaaaagataacaggtaagcactgaagacttgttttataagtgtcccaagcgagacctagagtggatattgatatttctcaaacaagactcgtcgaagaaaacacacttttatagcggaaccgctttctttatttgaattgtcttgttcaccaaggatgaaagtccaaataaccaatagtagaacagaggaaatcttaaaagttcaagctaataatgaaaacgatgaagtcagtaaagctactccgggcgaagttgaagaatcgctaaggttaatcggcgatctaaaattctttttagccacagcgccggtaaattggcaagaaaaccaaattataaggcgatactatctgaatagtggacaaggctttgtctcttgtgtattttggaacaatctatactatattacaggtactgatattgtcaaatgttgtctttacagaatgcaaaagtttgggagagaagtagttcaaaagaaaaaatttgaagagggtattttttcagatttaagaaatctcaaatgtggtatagatgcaactttagaacaaccaaagtccgaatttttgtcgtttctattcagaaatatgtgtctgaaaacccaaaaaaagcagaaagtatttttttggttcagtgtagcacatgataagttgtttgcggatgcgttggaaagagatttaaaaagagaaagtttgaatcagccttcaacgactaagcccgttaatgagcccgccttatctttttcatatgattcctcatctgataagcctctctacgatcagttacttcaacatttagattctagaagaccatctagtacaacaaaatcagataattcgcctccaaaattagaaagcgagaattttaaggataatgagttggtaacagtaactaatcagccgcttttaggcgttggcctcatggatgacgatgcgccagaatccccctctcaaattaatgattttattcctcagaaattgattatagaacccaatactctcgaattgaatggtctcacagaagaaacgcctcatgacttacccaagaataccgctaagggcagagacgaagaagattttcctctcgactattttcctgtatctgttgaataccctacggaggaaaatgcgtttgatccgttccctccacaggcttttacgccagctgccccttccatgcctatttcctatgataacgtgaatgaaagggattctatgcccgttaattctcttcttaatagatacccctatcagttatcagtggcacccactttcccagtgccaccatcatcatcgaggcaacattttatgacaaatcgggatttttattcatctaacaataacaaggaaaaattggtatctcctagcgaccctaccagctacatgaagtatgacgaaccagttatggattttgatgaatctcggccaaatgaaaactgtacaaatgcaaaatctcacaactctggccagcaaactaaacaacaccaattatattctaacaacttccagcaatcttacccaaacggaatggttccaggatactacccaaaaatgccgtataatcccatggggggggatcctctactcgatcaagccttttatggcgcggacgattttttctttccaccagaaggatgtgataacaatatgctgtatccacaaactgcaacttcatggaatgttttgccccctcaagctatgcaaccagctccaacctatgttgggagaccatacacaccgaattatagatcgacaccaggttccgcgatgttcccatacatgcaaagttcaaattccatgcagtggaacactgctgtttcaccttatagttcgagagcaccatctacaactgctaaaaactatcctcctagcacattttattctcaaaatataaatcaatacccacggcgaagaactgtgggaatgaagtcttcacaaggaaatgttccaacaggtaataaacaatctgtgggcaagtctgcaaaaatttcaaagcctctacatattaagacaagtgcttatcagaagcaatacaaaatcaacttggaaacgaaagccaggccaagtgctggtgacgaagattctgctcatcctgataagaacaaagaaatttcgatgcctactccggattccaatactttggtggtccagtcagaagaaggtggagctcattcacttgaggtagataccaatcgaaggtccgataaaaaccttccagatgcaacctgatataatataatttttgaatttatgatacaagaattaaaaatgcgggccagaatttaatattaaacaatactcagaagaaaacaacaaggacaatctgtttttataaataaaacaatcttatacaagactagagcaaacaaaaagcaagaaaaaaaggtaataaatgtaacaaatctattaacgttagaaaataacaaaaaaaaaaaaagaaaaagataatataatataatacctttatatatgtgatttatctagcgtcacagtatgtaatataaatatcaatgagtttcttaacatgacctccaaaactacatgatcgcttagtattacaatatgtgtttatccactattttgataccaacgtagtattgccttttatttttcagaatggcaaaggccatcggaaaatttttccaccagaaaaagcgagattcctaattataaggtgaaggcatcgatgttcataatagttaaaagttgtaatcaaaaaagaaaaaggtgcagagataaacaaagttaataaatgacaaaatcaagaaagcagaagcaaaaaaagcaggattttttgagaaaaaagttaaaagttggtaagccaaaggaaaaagcaaggaatgctaccgatacatctttcgtttccaagactatttctattagaaatcaacatttagaccaaaatccacatgatttaacaaaacggctaacgctcttaaagcatcataacatcaatgtgagaaaggaaacattaacaacattccaaaagtcaataccgtctataataaaatctcgacttatgacaccattacttactcaaagtataccgttgatttgcgatgaatcgcagcaagtacgtcagggacttattgatctcgtagatgaaataggtagtcacgatgcggagattttaaaattgcactgcaacatttttgtcttatacattaacatggcaatgacacatattgttacacaaattcaagcagattctactaaatttctctctcat

SEQ ID NO: 136 - protein, 688 aa, Saccharomyces cerevisiae; identical to SEQ ID NO: 24

SEQ ID NO: 137 - DNA, 3548 bp, Saccharomyces cerevisiae
accagtggtcaccatacatgaaataccacagtgttttcccaatgtacggacgacttgggaagtttgcagagctaactctcttgtgggaaccatgatcaaagcctgaattttattcaactttggtttgactttctctaacgtaggaataacaaatgcggctgtcttacctgtaccattctttgctctggccaatatgtctctaccagttattgctaccggaatagcctcttcttgaataggggatggtttttcaaaaccggcttcaaaaatacccattaacagctctcttttcaaataaaaatcttcaaaagtattaccctttgtatttaagacatcgtctgtctgtggtctggtatccttcttgggaatattcaatgcagttttccagtcccgatcgagatccgtattactgttattattagtgttgaagttattattgatggaacccattactactattttctttcttgtcgtattttaggcctgggataagttattatgcgaatggcgatgcggttatgaagaaataaaagggctaaaagtaagaattttctgcgtctatctttctattaggaataaaatatgactatatttactattattgttgttttgtcgtacaatcctttatgaatgaaaatattaagcttgtggtcttaaaagaatgtggatgaaacaaaactgaatccaatgatgagaaataaatgtacaatcagataataaacacttttattgatgattgtcttttcttgcaaaccccaatgttacaatcgcccattagttctaagattgtgttgtcctttttcttacgaaatttttttccctcccttttttgatcactgtcctcgttataagtgattcgtggggtaacggcgatatcatactattattggcccatctgatggattagaagacctacaggttaatgtgaagcgacactaatgataagaaaactgcatcggatcatatctgtttttgcagcgtggtatattggttgttggtcatgtttcaacgaaagactttacagagaaggaacttgaaagggctcaatcttaacctgcacccagatgtgggcaataatggccaattgcaggaaaagacagagactcaccagggacaatctcgaatagaaggccacgtgatgtctaacattaatgcaatacagaataatagcaacctgtttttgcgaagaggcataaaaaaaaaactgacgttggatgcgtttggtgatgaccaagctatatcgaaaccaaacactgtggtaatacagcaaccgcaaaatgaacctgttttagttctgtcttctctatcacaatccccgtgtgtaacatcatcatcatctttgtccacgccatgcattatagatgcgtacagtaataatttcggattatcgccatcatccacgaattctactccctctacgattcagggattgtccaatattgcaacgccagttgaaaacgaacattcgatatcactaccacctttggaggaaagcctatcgccagccgcagcagatctgaaagatacgttgtcgggaacttcaaatggtaattatatacaactccgggacttggttcagttggggaaaattggtgctggaaattctggaactgtggtgaaggcactacatgttcctgattccaaaatagttgccaaaaaaaccattcctgtggaacagaataacagtacaatcatcaaccaattagttagggaattatctatcgtcaaaaacgttaagccccatgaaaacattatcaccttctatggagcttattataaccagcatataaataatgaaatcataattttaatggaatactctgattgtggttctttagataaaatactgtccgtttataaaaggtttgttcaaagagggactgtttcgagtaagaaaacttggttcaacgaattaacaatatcaaaaatagcgtacggcgtactaaatggcttggatcatttgtaccgacaatataagataattcatcgtgatatcaagccttccaatgttctgattaatagtaaggggcagattaagttatgtgattttggagtttccaaaaaactaataaattctatcgctgatacatttgttggaacgtccacttatatgtcaccagagaggatacaaggaaacgtttattctatcaaaggggacgtttggtcattgggcttaatgatcatcgagctggtaactggagagtttcccctaggtgggcataacgatacacctgatggcatattggatttgctgcaacgtattgtcaacgagccttcaccaagattacccaaagaccgtatctattccaaggaaatgacagattttgtcaataggtgttgtattaagaatgaaagggaaaggtcatcgattcatgaattgctacatcatgatcttataatgaaatacgtatcaccgtctaaagatgataaatttagacattggtgtagaaaaataaaatctaaaataaaggaagacaagagaattaaaagagaagccttggaccgtgccaagttagaaaagaaacaatcggaaagatcaacccattgaatgcatgcgataacattagttaggaacatattgcactttttttcacatccctttctcaaaactatattcatatatatatagactctcctgattatgtaaatcaaaaccaattttctaatgtaacaatatttttaaaaataatcatcaaagtagcactttatgtacagaaaatttcacgattgagagaagcttgcgaataatactagttagcctgtgtttcaccatcgttacttaatttcttatagttcttatattctttatttttatgccacaaccaaccttcggttcctctaacgaaaccgaaggcgattaataacccaccgaagctacgtaaagttactttccaccattgtgggtttcttttttcaaattcagtcagagaaatgcctcttttggcttcttttttaccatacttgaatggtttcccagatgccaagtatgagccaaatccaacagaaaacatagtgctcatgacttgacaaggaacgcaatccatagtctcttctttttccagctccctttgtggtggagggttgaacactgccaaaatattactcattgtttttcaccacttgctgtttctctctaagcggtgttttgtttcctacttggtggcacacaatgactgtactcgctttatatgctcgtaccttttttcaaaagcccatcgttaatttttcacccgaggaccccatattacgcgttttttgttaatgttcaatttctgacatgttacaattataataacgccaaaagaggtaaatgtatatttgaacaattgttaaagagaagataaaaaccttttaatcttgcatttgtcgtcaatagtacacaataggcgatctattttagtacggtaattaaaagaaagctgcctttcagtcaagaatgccggaattaacagaatttcagaaaaaacgtttagagaacatcaaaaggaataacgatttattgaaaaaactccacctttctggagtagcatctcaaattaagcacgagg

SEQ ID NO: 138 - protein, 515 aa, Saccharomyces cerevisiae; identical to SEQ ID NO: 82

SEQ ID NO: 139 - DNA, 4154 bp, Saccharomyces cerevisiae; identical to SEQ ID NO: 111

SEQ ID NO: 140 - protein, 717 aa, Saccharomyces cerevisiae; identical to SEQ ID NO: 84

SEQ ID NO: 141 - DNA, 11077 bp, Artificial Sequence
  Phase I disruption construct nucleotide sequence
gacggcacggccacgcgtttaaaccgcccagatggaatcccttccatagagagaaggagcaagcaactgacccaatattgactgccactggacctgaagacatgcaacaaagtgcaagcatagtggggccttcttccaatgctaatccggtcactgccactgctgctacggaaaaccaacctaaaggtattaacttcttcactataagaaaatcacacgagcgcccggacgatgtctctgtttaaatggcgcaagttttccgctttgtaatatatatttatacccctttcttctctcccctgcaatataatagtttaattctaatattaataatatcctatattttcttcatttaccggcgcactctcgcccgaacgacctcaaaatgtctgctacattcataataaccaaaagctcataacttttttttttgaacctgaatatatatacatcacatgtcactgctggtccttgccgaccagcgtatacaatctcgatagttggtttcccgttctttccactcccgtcgctcacacgcggccagggggagccgagctcctcgagaagttaagattatatgaataactaaatactaaatagaaatgtaaatacagtgagaacaaaacaaaaaaaaacgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtattactagtgtcgacgctcgtccaacgccggcggacctagttatgacaattacaacaacagaattctttctatatatgcacgaacttgtaatatggaagaaattatgacgtacaaactataaagtaaatattttacgtaacacatggtgctgttgtgcttctttttcaagagaataccaatgacgtatgactaagtttaggatttaatgcaggtgacggacccatctttcaaacgatttatatcagtggcgtccaaattgttaggttttgttggttcagcaggtttcctgttgtgggtcatatgactttgaaccaaatggccggctgctagggcagcacataaggataattcacctgccaagacggcacaggcaactattcttgctaattgacgtgcgttggtaccaggagcggtagcatgtgggcctcttacacctaataagtccaacatggcaccttgtggttctagaacagtaccaccaccgatggtacctacttcgatggatggcatggatacggaaattctcaaatcaccgtccacttctttcatcaatgttatacagttggaactttcgacattttgtgcaggatcttgtcctaatgccaagaaaacagctgtcactaaattagctgcatgtgcgttaaatccaccaacagacccagccattgcagatccaaccaaattcttagcaatgttcaactcaaccaatgcggaaacatcactttttaacacttttctgacaacatcaccaggaatagtagcttctgcgacgacactcttaccacgaccttcgatccagttgatggcagctggttttttgtcggtacagtagttaccagaaacggagacaacctccatatcttcccagccatactcttctaccatttgctttaatgagtattcgacacccttagaaatcatattcatacccattgcgtcaccagtagttgttctaaatctcatgaagagtaaatctcctgctagacaagtttgaatatgttgcagacgtgcaaatcttgatgtagagttaaaagcttttttaattgcgttttgtccctcttctgagtctaaccatatcttacaggcaccagatcttttcaaagttgggaaacggactactgggcctcttgtcataccatccttagttaaaacagttgttgcaccaccgccagcattgattgccttacagccacgcatggcagaagctaccaaacaaccctctgtagttgccattggtatatgataagatgtaccatcgataaccaaggggcctataacaccaacgggcaaaggcatgtaacctataacattttcacaacaagcgccaaatacgcggtcgtagtcataatttttatatggtaaacgatcagatgctaatacaggagcttctgccaaaattgaaagagccttcctacgtaccgcaaccgctctcgtagtatcacctaattttttctccaaagcgtacaaaggtaacttaccgtgaataaccaaggcagcgacctctttgttcttcaattgttttgtatttccactacttaataatgcttctaattcttctaaaggacgtattttcttatccaagctttcaatatcgcgggaatcatcttcctcactagatgatgaaggtcctgatgagctcgattgcgcagatgataaacttttgactttcgatccagaaatgactgttttattggttaaaactggtgtagaagccttttgtacaggagcagtaaaagacttcttggtgacttcagtcttcaccaattgatctgcagccatatccccgcgtgcttggccggccgttactttttttttggatggacgcaaagaagtttaataatcatattacatggcaataccaccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggcgacagccctccgacggaagactctcctccgtgcgtcctggtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatcaacgaatcaaattaacaaccataggataataatgcgattagttttttagccttatttctggggtaattaatcagcgaagcgatgatttttgatctattaacagatatataaatgcaaaagctgcataaccactttaactaatactttcaacattttcggtttgtattacttcttattcaaatgtcataaaagtatcaacaaaaaattgttaatatacctctatacttaacctgcaggccgcgagcgccgatatgtctcagaacgtttacattgtatcgactgccagaaccccaattggttcattccagggttctctatcctccaagacagcagtggaattgggtgctgttgctttaaaaggcgccttggctaaggttccagaattggatgcatccaaggattttgacgaaattatttttggtaacgttctttctgccaatttgggccaagctccggccagacaagttgctttggctgccggtttgagtaatcatatcgttgcaagcacagttaacaaggtctgtgcatccgctatgaaggcaatcattttgggtgctcaatccatcaaatgtggtaatgctgatgttgtcgtagctggtggttgtgaatctatgactaacgcaccatactacatgccagcagcccgtgcgggtgccaaatttggccaaactgttcttgttgatggtgtcgaaagagatgggttgaacgatgcgtacgatggtctagccatgggtgtacacgcagaaaagtgtgcccgtgattgggatattactagagaacaacaagacaattttgccatcgaatcctaccaaaaatctcaaaaatctcaaaaggaaggtaaattcgacaatgaaattgtacctgttaccattaagggatttagaggtaagcctgatactcaagtcacgaaggacgaggaacctgctagattacacgttgaaaaattgagatctgcaaggactgttttccaaaaagaaaacggtactgttactgccgctaacgcttctccaatcaacgatggtgctgcagccgtcatcttggtttccgaaaaagttttgaaggaaaagaatttgaagcctttggctattatcaaaggttggggtgaggccgctcatcaaccagctgattttacatgggctccatctcttgcagttccaaaggctttgaaacatgctggcatcgaagacatcaattctgttgattactttgaattcaatgaagccttttcggttgtcggtttggtgaacactaagattttgaagctagacccatctaaggttaatgtatatggtggtgctgttgctctaggtcacccattgggttgttctggtgctagagtggttgttacactgctatccatcttacagcaagaaggaggtaagatcggtgttgccgccatttgtaatggtggtggtggtgcttcctctattgtcattgaaaagatatgattacgttctgcgattttctcatgatctttttcataaaatacataaatatataaatggctttatgtataacaggcataatttaaagttttatttgcgattcatcgtttttcaggtactcaaacgctgaggtgtgccttttgacttacttttccgccttggcaagctggccgggtgatacttgcacaagttccactaattactgacatttgtggtattaactcgtttgactgctctacaattgtaggatgttaatcaatgtcttggctgcctaacgcgatcgccgacgccgccgatatgagaaaaaaaatcggttgggcttaactttaaagaaaaaagttgagattagatttattgtgttataaatatagatatacaattctttataaaaaaaatatatatatatatcattgttattaaataaagagttttcctagtatatagattaaaaaactactctattaaatgagagctaaaaaaagcaggctgccaaaaaaataaagcatttatgaagggggttcagcaagatgcaatcgatgggggaagattattttttaacatcgtaagatcttctaaatttgtcatcgatgttggtcaagtagtaaacaccactttgcaaatgctcaatggaaccttgaggtttgaagttcttcttcaaatgggcattttctctcaattcgatggcagcttcgtaatcctttggagtttcggtgattctcttggctaatttgttagtaatatctaattccttgataatatgttggacgtcaccaacaattttgcaagaatatagagatgcagctaaaccggaaccgtaagaaaataaaccaacacgcttgccttgtaagtcgtcagatccaacatagtttaatagagatgcaaaggcggcataaacagatgcggtgtacatgttacctgtgtttgttggaacaatcaaagattgggcaactctctctttgtggaatggcttagcaacattaacaaaagttttttcaatgttcttatcggttaaagattcgtcataatcgcgagtagctaattcggcgtcaacttctgggaacaattgaggattggctctgaaatcgttatatagtaatctaccgtatgattttgtgaccaatttacaggttggaacatggaaaacgttgtagtcgaaatatttcaaaacgttcaaagcatccgaaccagcgggatcgctaaccaaccctttagaaatagccttcttggaataactcttgtaaacttgatcaagagccttgacgtaacaagttaatgaaaaatgaccatcgacgtaaggatattcgctggtgaaatctggcttgtaaaaatcgtaggcgtgttccatgtaagaagctcttacagagtcaaatacaattggagcatcaggaccgatccacatagcaacagtaccggcaccaccggttggtcttgcggcacccttatcgtagatggcaatatcaccgcaaactacaatggcgtctctaccatcccatgcgttagattcaatccagttcaaagagttgaacaacgcgttggtaccaccgtaacaggcattaagcgtgtcaataccttcgacgtcagtgttttcaccaaacaattgcatcaagacagacttgacagacttggacttgtcaatcagagtttcagtaccgacttctaatctaccaattttgttggtgtcgatgttgtaactcttgatcaacttagacaaaacagttagggacatcgagtagatatcttctctgtcattgacaaaagacatgttggtttggcccagaccaattgtgtatttaccttgagaaacgccatcaaatttctctagctcagattggttgacacattgagttgggatgtaaatttggatacctttaataccgacattttgaggtctggttttttgttcagcggtcttttgtttttttagttcagtcatttgcaagtttgtattgtgtaattgttgttgcttttgcggcctaagtcttcctttaataccacaccaacaaagtttagtagagagtttcataaggcggccgctggcgagggagataagtatagaggtatattaacaattttttgttgatacttttatgacatttgaataagaagtaatacaaaccgaaaatgttgaaagtattagttaaagtggttatgcagcttttgcatttatatatctgttaatagatcaaaaatcatcgcttcgctgattaattaccccagaaataaggctaaaaaactaatcgcattattatcctatggttgttaatttgattcgttgatttgaaggtttgtggggccaggttactgccaatttttcctcttcataaccataaaagctagtattgtagaatctttattgttcggagcagtgcggcgcgaggcacatctgcgtttcaggaacgcgaccggtgaagaccaggacgcacggaggagagtcttccgtcggagggctgtcgcccgctcggcggcttctaatccgtacttcaatatagcaatgagcagttaagcgtattactgaaagttccaaagagaaggtttttttaggctaagataatggggctctttacatttccacaacatataagtaagattagatatggatatgtatatggtggtattgccatgtaatatgattattaaacttctttgcgtccatccaaaaaaaaagtaaaggcgcgccacggtcgtgcggatatggctgcagatcaattggtgaagactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaagggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgtcgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccacatgctaccgctcctggtaccaacgcacgtcaattagcaagaatagttgcctgtgccgtcttggcaggtgaattatccttatgtgctgccctagcagccggccatttggttcaaagtcatatgacccacaacaggaaacctgctgaaccaacaaaacctaacaatttggacgccactgatataaatcgtttgaaagatgggtccgtcacctgcattaaatcctaaacttagtcatacgtcattggtattctcttgaaaaagaagcacaacagcaccatgtgttacgtaaaatatttactttatagtttgtacgtcataatttcttccatattacaagttcgtgcatatatagaaagaattctgttgttgtaattgtcataactagcccctcagcccccctagcgtcgaagcatcttgccctgtgcttggcccccagtgcagcgaacgttataaaaacgaatactgagtatatatctatgtaaaacaaccatatcatttcttgttctgaactttgtttacctaactagttttaaatttccctttttcgtgcatgcgggtgttcttatttattagcatactacatttgaaatatcaaatttccttagtagaaaagtgagagaaggtgcactgacacaaaaaataaaatgctacgtataactgtcaaaactttgcagcagcgggcatccttccatcatagcttcaaacatattagcgttcctgatcttcatacccgtgctcaaaatgatcaaacaaactgttattgccaagaaataaacgcaaggctgccttcaaaaactgatccattagatcctcatatcaagcttcctcatagaacgcccaattacaataagcatgttttgctgttatcaccgggtgataggtttgctcaaccatggaaggtagcatgcggtgtttaaaccccagcgcctggcggg

SEQ ID NO: 142 - DNA, 9664 bp, Artificial Sequence
  Phase II disruption construct nucleotide sequence
gacggcacggccacgcgtttaaaccgcctaggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagcgccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctagctcacacgcggccagggggagcctcgacactagtaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaaatgaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgccggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctgagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatcttaacttctcgaggagctccgctcgtccaacgccggcggacctattcgcgggtggaaggaccttgtggaggaatatgaagttgatagctcaaagggattgaatggctatttaactgattatgagtcaatgtatcaaggatactatggtctgcttaaatttcattctgtcttcgaaagctgaattgatactacgaaaaatttttttttgtttctctttctatctttattacataaaacttcatacacagttaagattaaaaacaactaataaataatgcctatcgcaaattagcttatgaagtccatggtaaattcgtgtttcctggcaataatagatcgtcaatttgttgctttgtggtagttttattttcaaataattggaatactagggatttgattttaagatctttattcaaattttttgcgcttaacaaacagcagccagtcccacccaagtctgtttcaaatgtctcgtaactaaaatcatcttgcaatttctttttgaaactgtcaatttgctcttgagtaatgtctcttcgtaacaaagtcaaagagcaaccgccgccaccagcaccggtaagttttgtggagccaattctcaaatcatcgctcagatttttaataagttctaatccaggatgagaaacaccgattgagacaagcagtccatgatttattcttatcaattccaatagttgttcatacagttcattattagtttctacagcctcgtcatcggtgcctttacatttacttaacttagtcatgatctctaagccttgtagggcacattcacccatggcatctagaattggcttcataacttcaggaaatttctcggtgaccaacacacgaacgcgagcaacaagatcttttgtagaccttggaattctagtataggttaggatcattggaatggctgggaaatcatctaagaacttaaaattgtttgtgtttattgttccattatgtgagtctttttcaaatagcagggcattaccataagtggccacagcgttatctattcctgaaggggtaccgtgaatacacttttcacctatgaaggcccattgattcactatatgcttatcgttttctgacagcttttccaagtcattagatcctattaacccccccaagtaggccatagctaaggccagtgatacagaaatagaggcgcttgagcccaacccagcaccgatgggtaaagtagactttaaagaaaacttaatattcttggcatgggggcataggcaaacaaacatatacaggaaacaaaacgctgcatggtagtggaaggattcggatagttgagctaacaacggatccaaaagactaacgagttcctgagacaagccatcggtggcttgttgagccttggccaatttttgggagtttacttgatcctcggtgatggcattgaaatcattgatggaccacttatgattaaagctaatgtccgggaagtccaattcaatagtatctggtgcagatgactcgcttattagcaggtaggttctcaacgcagacacactagcagcgacggcaggcttgttgtacacagcagagtgttcaccaaaaataataacctttcccggtgcagaagttaagaacggtaatgacatatccccgcgtgcttggccggccgttactttttttttggatggacgcaaagaagtttaataatcatattacatggcaataccaccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggcgacagccctccgacggaagactctcctccgtgcgtcctggtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatcaacgaatcaaattaacaaccataggataataatgcgattagttttttagccttatttctggggtaattaatcagcgaagcgatgatttttgatctattaacagatatataaatgcaaaagctgcataaccactttaactaatactttcaacattttcggtttgtattacttcttattcaaatgtcataaaagtatcaacaaaaaattgttaatatacctctatacttaacctgcaggccgcgagcgccgatatgtcagagttgagagccttcagtgccccagggaaagcgttactagctggtggatatttagttttagatccgaaatatgaagcatttgtagtcggattatcggcaagaatgcatgctgtagcccatccttacggttcattgcaagagtctgataagtttgaagtgcgtgtgaaaagtaaacaatttaaagatggggagtggctgtaccatataagtcctaaaactggcttcattcctgtttcgataggcggatctaagaaccctttcattgaaaaagttatcgctaacgtatttagctactttaagcctaacatggacgactactgcaatagaaacttgttcgttattgatattttctctgatgatgcctaccattctcaggaggacagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttatcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttaatgaagaagactggaatataacgattaaaagtaaccatttaccttcgggattaactttatggatgggcgatattaagaatggttcagaaacagtaaaactggtccagaaggtaaaaaattggtatgattcgcatatgccggaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgagatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattgctaagcaagatgttgatcttagggctcaaaccgctgatgacaaaagattttctaaggttcaatggctggatgtaactcaggctgactggggtgttaggaaagaaaaagatccggaaacttatcttgataaataacttaaggtagataatagtggtccatgtgacatctttataaatgtgaagtttgaagtgaccgcgcttaacatctaaccattcatcttccgatagtacttgaaattgttcctttcggcggcatgataaaattcgtttaatgggtacaagctatacatactaggatgaggatggtactgagaacgataaataaactttctagatatataactttatgtcatttaaatataaataaagtgcgtgttagcttgaaagtgtgcactaacgcgatcgccgacgccgccgatgatgtgtattactagtgtcgacgacagcattcgcccagtattttttttattctacaaaccttctataatttcaaagtatttacataattctgtatcagtttaatcaccataatatcgttttctttgtttagtgcaattaatttttcctattgttacttcgggcctttttctgttttatgagctattttttccgtcatccttccggatccagattttcagcttcatctccagattgtgtctacgtaatgcacgccatcattttaagagaggaaggcggccgctggcgagggagatatgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtatcgattgactcggcagctcatcatgataactccacaattccgttggattttatgcccagggatgcacttcatggatttgattggtctgaagaggatgacatgtcggatggcttgcccttcctgaaaacggaccccaacaataatgggttctttggcgacggttctctcttatgtattcttcgatctattggctttaaaccggaaaattacacgaactctaacgttaacaggctcccgaccatgattacggatagatacacgttggcttctagatccacaacatcccgtttacttcaaagttatctcaataattttcacccctactgccctatcgtgcactcaccgacgctaatgatgttgtataataaccagattgaaatcgcgtcgaaggatcaatggcaaatcctttttaactgcatattagccattggagcctggtgtatagagggggaatctactgatatagatgttttttactatcaaaatgctaaatctcatttgacgagcaaggtcttcgagtcaggttccataattttggtgacagccctacatcttctgtcgcgatatacacagtggaggcagaaaacaaatactagctataattttcacagcttttccataagaatggccatatcattgggcttgaatagggacctcccctcgtccttcagtgatagcagcattctggaacaaagacgccgaatttggtggtctgtctactcttgggagatccaattgtccctgctttatggtcgatccatccagctttctcagaatacaatctccttcccttcttctgtcgacgatgtgcagcgtaccacaacaggtcccaccatatatcatggcatcattgaaacagcaaggctcttacaagttttcacaaaaatctatgaactagacaaaacagtaactgcagaaaaaagtcctatatgtgcaaaaaaatgcttgatgatttgtaatgagattgaggaggtttcgagacaggcaccaaagtttttacaaatggatatttccaccaccgctctaaccaatttgttgaaggaacacccttggctatcctttacaagattcgaactgaagtggaaacagttgtctcttatcatttatgtattaagagattttttcactaattttacccagaaaaagtcacaactagaacaggatcaaaatgatcatcaaagttatgaagttaaacgatgctccatcatgttaagcgatgcagcacaaagaactgttatgtctgtaagtagctatatggacaatcataatgtcaccccatattttgcctggaattgttcttattacttgttcaatgcagtcctagtacccataaagactctactctcaaactcaaaatcgaatgctgagaataacgagaccgcacaattattacaacaaattaacactgttctgatgctattaaaaaaactggccacttttaaaatccagacttgtgaaaaatacattcaagtactggaagaggtatgtgcgccgtttctgttatcacagtgtgcaatcccattaccgcatatcagttataacaatagtaatggtagcgccattaaaaatattgtcggttctgcaactatcgcccaataccctactcttccggaggaaaatgtcaacaatatcagtgttaaatatgtttctcctggctcagtagggccttcacctgtgccattgaaatcaggagcaagtttcagtgatctagtcaagctgttatctaaccgtccaccctctcgtaactctccagtgacaataccaagaagcacaccttcgcatcgctcagtcacgccttttctagggcaacagcaacagctgcaatcattagtgccactgaccccgtctgctttgtttggtggcgccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtaaaatgaatcgtagatactgaaaaaccccgcaagttcacttcaactgtgcatcgtgcaccatctcaatttctttcatttatacatcgttttgccttcttttatgtaactatactcctctaagtttcaatcttggccatgtaacctctgatctatagaattttttaaatgactagaattaatgcccatcttttttttggacctaaattcttcatgaaaatatattacgagggcttattcagaagcttcgctcaaaggcgcgccacggtcgtgcggataaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctacggtgtttaaaccccagcgcctggcggg

SEQ ID NO: 143 - DNA, 8640 bp, Artificial Sequence
  Phase III disruption construct nucleotide sequence
gacggcacggccacgcgtttaaaccgccaaaagtgcagctcagagcccccagcaccagtattagaggtcataatgggctgcgaagcctgctaaaatgcagtggaggccgtgtaccctttgccaaattggctattggaatcggcagagaacctgggtcccgttctagagaccctgcgagcgtgtcccggtgggttctgggagctctaactccgcaggaactacaaaccttgcttacacagagtgaacctgctgcctggcgtgctctgactcagtacatttcatagcccatcttcaacaacaataccgacttaccatcctatttgctttgccctttttcttttccactgcactttgcatcggaaggcgttatcggttttgggtttagtgcctaaacgagcagcgagaacacgaccacgggctatataaatggaaagttaggacaggggcaaagaataagagcacagaagaagagaaaagacgaaaagcagaagcggaaaacgtatacacgtcacatatcacacacacacgctcacacgcggccagggggagcctcgacactagtaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaaatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatcttaacttctcgaggagctccgctcgtccaacgccggcggacctcttgtgctaagtggtgctgttagacagctacgaataaggaaattccgaagcatgtagggaggtcatgatatgaaaaagcaaaagagtaggcatcaaaaagtttctcattcaagtggtaactgctgttaaaattaagatatttataaattgaagcttggtcgttccgaccaataccgtagggaaacgtaaattagctattgtaaaaaaaggaaaagaaaagaaaagaaaaatgttacatatcgaattgatcttattcctttggtagaccagtctttgcgtcaatcaaagattcgtttgtttcttgtgggcctgaaccgacttgagttaaaatcactctggcaacatccttttgcaactcaagatccaattcacgtgcagtaaagttagatgattcaaattgatggttgaaagcctcaagctgctcagtagtaaatttcttgtcccatccaggaacagagccaaacaatttatagataaatgcaaagagtttcgactcattttcagctaagtagtacaacacagcatttggacctgcatcaaacgtgtatgcaacgattgtttctccgtaaaactgattaatggtgtggcaccaactgatgatacgcttggaagtgtcattcatgtagaatattggagggaaagagtccaaacatgtggcatggaaagagttggaatccatcattgtttcctttgcaaaggtggcgaaatctttttcaacaatggctttacgcatgacttcaaatctctttggtacgacatgttcaattctttctttaaatagttcggaggttgccacggtcaattgcataccctgagtggaactcacatcctttttaatatcgctgacaactaggacacaagctttcatctgaggccagtcagagctgtctgcgatttgtactgccatggaatcatgaccatcttcagcttttcccatttcccaggccacgtatccgccaaacaacgatctacaagctgaaccagacccctttcttgctattctagatatttctgaagttgactgtggtaattggtataacttagcaattgcagagaccaatgcagcaaagccagcagcggaggaagctaaaccagctgctgtaggaaagttattttcggagacaatgtggagtttccattgagataatgtgggcaatgaggcgtccttcgattccatttcctttcttaattggcgtaggtcgcgcagacaattttgagttctttcattgtcgatgctgtgtggttctccatttaaccacaaagtgtcgcgttcaaactcaggtgcagtagccgcagaggtcaacgttctgaggtcatcttgcgataaagtcactgatatggacgaattggtgggcagattcaacttcgtgtcccttttcccccaatacttaagggttgcgatgttgacgggtgcggtaacggatgctgtgtaaacggtcatatccccgcgtgcttggccggccgttactttttttttggatggacgcaaagaagtttaataatcatattacatggcaataccaccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggcgacagccctccgacggaagactctcctccgtgcgtcctggtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatcaacgaatcaaattaacaaccataggataataatgcgattagttttttagccttatttctggggtaattaatcagcgaagcgatgatttttgatctattaacagatatataaatgcaaaagctgcataaccactttaactaatactttcaacattttcggtttgtattacttcttattcaaatgtcataaaagtatcaacaaaaaattgttaatatacctctatacttaacctgcaggccgcgagcgccgatatggcttcagaaaaagaaattaggagagagagattcttgaacgttttccctaaattagtagaggaattgaacgcatcgcttttggcttacggtatgcctaaggaagcatgtgactggtatgcccactcattgaactacaacactccaggcggtaagttaaatagaggtttgtccgttgtggacacgtatgctattctctccaacaagaccgttgaacaattggggcaagaagaatacgaaaaggttgctattctaggttggtgcattgagttgttgcaggcttacttcttggtcgccgatgatatgatggacaagtccattaccagaagaggccaaccatgttggtacaaggttcctgaagttggggaaattgccatcaatgacgcattcatgttagaggctgctatctacaagcttttgaaatctcacttcagaaacgaaaaatactacatagatatcaccgaattgttccatgaagtcaccttccaaaccgaattgggccaattgatggacttaatcactgcacctgaagacaaagtcgacttgagtaagttctccctaaagaagcactccttcatagttactttcaagactgcttactattctttctacttgcctgtcgcattggctatgtacgttgccggtatcacagatgaaaaggatttgaaacaagccagagatgtcttgattccattgggtgaatatttccaaattcaagatgactacttagactgcttcggtaccccagaacagatcggtaagatcggtacagatatccaagataacaaatgttcttgggtaatcaacaaggcattagaacttgcttccgcagaacaaagaaagactttagacgaaaattacggtaagaaggactcagtcgcagaagccaaatgcaaaaagattttcaatgacttgaaaatcgaccagttataccacgaatatgaagagtctgttgccaaggatttgaaggccaagatctcccaagtcgacgagtctcgtggcttcaaagccgacgtcttaactgcgtttttgaacaaggtttacaagagaagtaaataagactggaagcgttcaatcgataaaaattggaatacagattagataaggaccatgtataagaaatatatacttccactataatatagtataagcttacagataattatctcttgatttaccgttacacgtgactaaaggacgctttttctcagccaatgaaagtgaagaaaaacttgatcggaaattacgggtagtacgtaaaaggaacttgagccaccccccaaaaatttacccatataataataggaaaagcaacgacctcaaacgcgatcgccgacgccgccgatgacggtagcaacaagaatatagcacgagccgcgaagttcatttcgttacttttgatatcgctcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcattagatatattttctgtcattttccttaacccaaaaataagggaaagggtccaaaaagcgctcggacaactgttgaccgtgatccgaaggactggctatacagtgttcacaaaatagccaagctgaaaataatgtgtagctatgttcagttagtttggctagcaaagatataaaagcaggtcggaaatatttatgggcattattatgcagagcatcaacatgataaaaaaaaggcggccgctggcgagggagatatgactgccgacaacaatagtatgccccatggtgcagtatctagttacgccaaattagtgcaaaaccaaacacctgaagacattttggaagagtttcctgaaattattccattacaacaaagacctaatacccgatctagtgagacgtcaaatgacgaaagcggagaaacatgtttttctggtcatgatgaggagcaaattaagttaatgaatgaaaattgtattgttttggattgggacgataatgctattggtgccggtaccaagaaagtttgtcatttaatggaaaatattgaaaagggtttactacatcgtgcattctccgtctttattttcaatgaacaaggtgaattacttttacaacaaagagccactgaaaaaataactttccctgatctttggactaacacatgctgctctcatccactatgtattgatgacgaattaggtttgaagggtaagctagacgataagattaagggcgctattactgcggcggtgagaaaactagatcatgaattaggtattccagaagatgaaactaagacaaggggtaagtttcactttttaaacagaatccattacatggcaccaagcaatgaaccatggggtgaacatgaaattgattacatcctattttataagatcaacgctaaagaaaacttgactgtcaacccaaacgtcaatgaagttagagacttcaaatgggtttcaccaaatgatttgaaaactatgtttgctgacccaagttacaagtttacgccttggtttaagattatttgcgagaattacttattcaactggtgggagcaattagatgacctttctgaagtggaaaatgacaggcaaattcatagaatgctataacaacgcgtcaataatataggctacataaaaatcataataactttgttatcatagcaaaatgtgatataaaacgtttcatttcacctgaaaaatagtaaaaataggcgacaaaaatccttagtaatatgtaaactttattttctttatttatttacagaactctgaatatacattgattgttcacattttttttttctcttctcaatttcccttgattatattcaaaaggttattggcctcttgaatgtttcccactgatgaaggcgcgccacggtcgtgcggatgtattccaatgagaatcgctagaaatgctttaccagaactagactacttgtcgcagatcacttttgaactgtatgagagtacggatgcttctggtcaaaaatcgcattccattagactgaaaatgtctcctgggtgtcatactcgagatccgttagatgttcaattagatgacaggcattatattagttgtattccaaagatttccctgacgaagcatttggatatggactacgttcaacagaaattgagaaacaaatttaccagggtcattatgcctccgaaatttacaccagtaaacattacgagccccaacttgagtttccagaaacgcaaaaccagaagaaagtcggtatctgttgagaagttgaagcttcctgcctcgtccggatcttcatcatctacctccgttaacaagacattagattagtgatcacacccaatttttaatttagcaacccaaaataaataagtatttactcaacttttttttaataaaaaaaaacttaattgaattttgctcgcgatctttaggtccggggttttcgttgaacccttagacgagcaaattagcgccataaggatatacgtcagagcacattaattagtgacatatacctatataaagagcaaccttctccgatagacttgtaatttatcttatttcatttcctaacactttggtcgaagaagagggataaaaacagacgaaagcccctcagcccccctagcgtcgatgggaaagctattacaattggcattgcatccggtcgagatgaaggcagctttgaagctgaagttttgcagaacaccgctattctccatctatgatcagtccacgtctccatatctcttgcactgtttcgaactgttgaacttgacctccagatcgtttgctgctgtgatcagagagctgcatccagaattgagaaactgtgttactctcttttatttgattttaagggctttggataccatcgaagacgatatgtccatcgaacacgatttgaaaattgacttgttgcgtcacttccacgagaaattgttgttaactaaatggagtttcgacggaaatgcccccgatgtgaaggacagagccgttttgacagatttcgaatcgattcttattgaattccacaaattgaaaccagaatatcaagaagtcatcaaggagatcaccgagaaaatgggtaatggtatggccgactacatcttagatgaaaattacaacttgaatcggtgtttaaaccccagcgcctggcggg

SEQ ID NO: 144 - DNA, 6344 bp, Artificial Sequence
  Phase I marker recycling construct nucleotide sequence
gacggcacggccacgcgtttaaaccgcccagatggaatcccttccatagagagaaggagcaagcaactgacccaatattgactgccactggacctgaagacatgcaacaaagtgcaagcatagtggggccttcttccaatgctaatccggtcactgccactgctgctacggaaaaccaacctaaaggtattaacttcttcactataagaaaatcacacgagcgcccggacgatgtctctgtttaaatggcgcaagttttccgctttgtaatatatatttatacccctttcttctctcccctgcaatataatagtttaattctaatattaataatatcctatattttcttcatttaccggcgcactctcgcccgaacgacctcaaaatgtctgctacattcataataaccaaaagctcataacttttttttttgaacctgaatatatatacatcacatgtcactgctggtccttgccgaccagcgtatacaatctcgatagttggtttcccgttctttccactcccgtcgctcacacgcggccagggggagcctcactattattccataagatgatcattagcattacgttcaaaacgagtacaaataacttaagtaataacacgagccatatgaccattagcaagatgacaagcaagttaagaccaatcagcttccatcatagcatcagcttaacgttcaccattaataagagtagaaatttcaccttcaagacaataacgattttcgtggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcactcttcgcaatgtcaacagtacccttagtatattctccagtagctagggagcccttgcatgacaattctgctaacatcaaaaggcctctaggttcctttgttacttcttccgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacaccacatatgcgtatatataccaatctaagtctgtgctccttccttcgttcttccttctgctcggagattaccgaatcaaaaaaatttcaaagaaaccggaatcaaaaaaaagaacaaaaaaaaaaaagatgaattgaaaagctttatggaccctgaaaccactcactattattccataagatgatcattagcattacgttcaaaacgagtacaaataacttaagtaataacacgagccatatgaccattagcaagatgacaagcaagttaagaccaatcagcttccatcatagcatcagcttaacgttcaccattaataagagtagaaatttcaccttcaagacaataacgattttcgtgcgctcgtccaacgccggcggacctgacggtagcaacaagaatatagcacgagccgcggagttcatttcgttacttttgatatcactcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcattagatatattttctgtcattttccttaacccaaaaataagggaaagggtccaaaaagcgctcggacaactgttgaccgtgatccgaaggactggctatacagtgttcacaaaatagccaagctgaaaataatgtgtagctatgttcagttagtttggctagcaaagatataaaagcaggtcggaaatatttatgggcattattatgcagagcatcaacatgataaaaaaaaacagttgaatattccctcaaaaatccccgcgtgcttggccggccgtaattaataatgtcaactttgcctatttcttctgtgtcattttcctcttctacatcaccattagtcgtggacgacaaagtctcaaccaagcccgacgttatcagacatacaatgaatttcaatgcttctatttggggagatcaattcttgacctatgatgagcctgaagatttagttatgaagaaacaattagtggaggaattaaaagaggaagttaagaaggaattgataactatcaaaggttcaaatgagcccatgcagcatgtgaaattgattgaattaattgatgctgttcaacgtttaggtatagcttaccattttgaagaagagatcgaggaagctttgcaacatatacatgttacctatggtgaacagtgggtggataaggaaaatttacagagtatttcattgtggttcaggttgttgcgtcaacagggctttaacgtctcctctggcgttttcaaagactttatggacgaaaaaggtaaattcaaagagtctttatgcaatgatgcacaaggaatattagccttatatgaagctgcatttatgagggttgaagatgaaaccatcttagacaatgctttggaattcacaaaagttcatttagatatcatagcaaaagacccatcttgcgattcttcattgcgtacacaaatccatcaagccttaaaacaacctttaagaaggagattagcaaggattgaagcattacattacatgccaatctaccaacaggaaacatctcatgatgaagtattgttgaaattagccaagttggatttcagtgttttgcagtctatgcataaaaaggaattgtcacatatctgtaagtggtggaaagatttagatttacaaaataagttaccttatgtacgtgatcgtgttgtcgaaggctacttctggatattgtccatatactatgagccacaacacgctagaacaagaatgtttttgatgaaaacatgcatgtggttagtagttttggacgatacttttgataattatggaacatacgaagaattggagatttttactcaagccgtcgagagatggtctatctcatgcttagatatgttgcccgaatatatgaaattaatctaccaagaattagtcaatttgcatgtggaaatggaagaatctttggaaaaggagggaaagacctatcagattcattacgttaaggagatggctaaagaattagttcgtaattacttagtagaagcaagatggttgaaggaaggttatatgcctactttagaagaatacatgtctgtttctatggttactggtacttatggtttgatgattgcaaggtcctatgttggcagaggagacattgttactgaagacacattcaaatgggtttctagttacccacctattattaaagcttcctgtgtaatagtaagattaatggacgatattgtatctcacaaggaagaacaagaaagaggacatgtggcttcatctatagaatgttactctaaagaatcaggtgcttctgaagaggaagcatgtgaatatattagtaggaaagttgaggatgcctggaaagtaatcaatagagaatctttgcgtccaacagccgttcccttccctttgttaatgccagcaataaacttagctagaatgtgtgaggtcttgtactctgttaatgatggttttactcatgctgagggtgacatgaaatcttatatgaagtccttcttcgttcatcctatggtcgtttgagctagctaagatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaagaacctgcaggccgcgagcgccgatagttatgacaattacaacaacagaattctttctatatatgcacgaacttgtaatatggaagaaattatgacgtacaaactataaagtaaatattttacgtaacacatggtgctgttgtgcttctttttcaagagaataccaatgacgtatgactaagtttaggatttaatgcaggtgacggacccatctttcaaacgatttatatcagtggcgtccaaattgttaggttttgttggttcagcaggtttcctgttgtgggtcatatgactttgaaccaaatggccggctgctagggcagcacataaggataattcacctgccaagacggcacaggcaactattcttgctaattgacgtgcgttggtaccaggagcggtagcatgtgggcctcttacacctaataagtccaacatggcaccttgtggttctagaacagtaccaccaccgatggtacctacttcgatggatggcatggatacggaaattctcaaatcaccgtccacttctttcatcaatgttatacagttggaactttcgacattttgtgcaggatcttgtcctaatgccaagaaaacagctgtcactaaattagctgcatgtgcgttaaatccaccaacagacccagccattgcagatccaaccaaattcttagcaatgttcaactcaaccaatgcggaaacatcactttttaacacttttctgacaacatcaccaggaatagtagcttctgcgacgacactcttaccacgaccttcgatccagttgatggcagctggttttttgtcggtacagtagttaccagaaacggagacaacctccatatcttcccagccatactcttctaccatttgctttaatgagtattcgacacccttagaaatcatattcatacccattgcgtcaccagtagttgttctaaatctcatgaagagtaaatctcctgctagacaagtttgaatatgttgcagacgtgcaaatcttgatgtagagttaaaagcttttttaattgcgttttgtccctcttctgagtctaaccatatcttacaggcaccagatcttttcaaagttgggaaacggactactgggcctcttgtcataccatccttagttaaaacagttgttgcaccaccgccagcattgattgccttacagccacgcatggcagaagctaccaaacaaccctctgtagttgccattggtatatgataagatgtaccatcgataaccaaggggcctataacaccaacgggcaaaggcatgtaacctataacattttcacaacaagcgccaaatacgcggtcgtagtcataatttttatatggtaaacgatcagatgctaatacaggagcttctgccaaaattgaaagagccttcctacgtaccgcaaccgctctcgtagtatcacctaattttttctccaaagcgtacaaaggtaacttaccgtgaataaccaaggcagcgacctctttgttcttcaattgttttgtatttccactacttaataatgcttctaattcttctaaaggacgtattttcttatccaagctttcaatatcgcgggaatcatcttcctcactagatgatgaaggtcctgatgagctcgattgcgcagatgataaacttttgactttcgatccagaaatgactgttttattggttaaaactggtgtagaagccttttgtacaggagcagtaaaagacttcttggtgacttcagtcttcaccaattggtctgcagccatcggtgtttaaaccccagcgcctggcggg

SEQ ID NO: 145 - DNA, 6184 bp, Artificial Sequence
  Phase II marker recycling construct nucleotide sequence
gacggcacggccacgcgtttaaaccgcctaggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagcgccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctagctcacacgcggccagggggagcctcactattattccataagatgatcattagcattacgttcaaaacgagtacaaataacttaagtaataacacgagccatatgaccattagcaagatgacaagcaagttaagaccaatcagcttccatcatagcatcagcttaacgttcaccattaataagagtagaaatttcaccttcaagacaataacgattttcgtggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcactcttcgcaatgtcaacagtacccttagtatattctccagtagctagggagcccttgcatgacaattctgctaacatcaaaaggcctctaggttcctttgttacttcttccgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacaccacatatgcgtatatataccaatctaagtctgtgctccttccttcgttcttccttctgctcggagattaccgaatcaaaaaaatttcaaagaaaccggaatcaaaaaaaagaacaaaaaaaaaaaagatgaattgaaaagctttatggaccctgaaaccactcactattattccataagatgatcattagcattacgttcaaaacgagtacaaataacttaagtaataacacgagccatatgaccattagcaagatgacaagcaagttaagaccaatcagcttccatcatagcatcagcttaacgttcaccattaataagagtagaaatttcaccttcaagacaataacgattttcgtgcgctcgtccaacgccggcggacctgacggtagcaacaagaatatagcacgagccgcggagttcatttcgttacttttgatatcactcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcattagatatattttctgtcattttccttaacccaaaaataagggaaagggtccaaaaagcgctcggacaactgttgaccgtgatccgaaggactggctatacagtgttcacaaaatagccaagctgaaaataatgtgtagctatgttcagttagtttggctagcaaagatataaaagcaggtcggaaatatttatgggcattattatgcagagcatcaacatgataaaaaaaaacagttgaatattccctcaaaaatccccgcgtgcttggccggccgtaattaataatgtcaactttgcctatttcttctgtgtcattttcctcttctacatcaccattagtcgtggacgacaaagtctcaaccaagcccgacgttatcagacatacaatgaatttcaatgcttctatttggggagatcaattcttgacctatgatgagcctgaagatttagttatgaagaaacaattagtggaggaattaaaagaggaagttaagaaggaattgataactatcaaaggttcaaatgagcccatgcagcatgtgaaattgattgaattaattgatgctgttcaacgtttaggtatagcttaccattttgaagaagagatcgaggaagctttgcaacatatacatgttacctatggtgaacagtgggtggataaggaaaatttacagagtatttcattgtggttcaggttgttgcgtcaacagggctttaacgtctcctctggcgttttcaaagactttatggacgaaaaaggtaaattcaaagagtctttatgcaatgatgcacaaggaatattagccttatatgaagctgcatttatgagggttgaagatgaaaccatcttagacaatgctttggaattcacaaaagttcatttagatatcatagcaaaagacccatcttgcgattcttcattgcgtacacaaatccatcaagccttaaaacaacctttaagaaggagattagcaaggattgaagcattacattacatgccaatctaccaacaggaaacatctcatgatgaagtattgttgaaattagccaagttggatttcagtgttttgcagtctatgcataaaaaggaattgtcacatatctgtaagtggtggaaagatttagatttacaaaataagttaccttatgtacgtgatcgtgttgtcgaaggctacttctggatattgtccatatactatgagccacaacacgctagaacaagaatgtttttgatgaaaacatgcatgtggttagtagttttggacgatacttttgataattatggaacatacgaagaattggagatttttactcaagccgtcgagagatggtctatctcatgcttagatatgttgcccgaatatatgaaattaatctaccaagaattagtcaatttgcatgtggaaatggaagaatctttggaaaaggagggaaagacctatcagattcattacgttaaggagatggctaaagaattagttcgtaattacttagtagaagcaagatggttgaaggaaggttatatgcctactttagaagaatacatgtctgtttctatggttactggtacttatggtttgatgattgcaaggtcctatgttggcagaggagacattgttactgaagacacattcaaatgggtttctagttacccacctattattaaagcttcctgtgtaatagtaagattaatggacgatattgtatctcacaaggaagaacaagaaagaggacatgtggcttcatctatagaatgttactctaaagaatcaggtgcttctgaagaggaagcatgtgaatatattagtaggaaagttgaggatgcctggaaagtaatcaatagagaatctttgcgtccaacagccgttcccttccctttgttaatgccagcaataaacttagctagaatgtgtgaggtcttgtactctgttaatgatggttttactcatgctgagggtgacatgaaatcttatatgaagtccttcttcgttcatcctatggtcgtttgagctagctaagatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaagaacctgcaggccgcgagcgccgtaattcgcgggtggaaggaccttgtggaggaatatgaagttgatagctcaaagggattgaatggctatttaactgattatgagtcaatgtatcaaggatactatggtctgcttaaatttcattctgtcttcgaaagctgaattgatactacgaaaaatttttttttgtttctctttctatctttattacataaaacttcatacacagttaagattaaaaacaactaataaataatgcctatcgcaaattagcttatgaagtccatggtaaattcgtgtttcctggcaataatagatcgtcaatttgttgctttgtggtagttttattttcaaataattggaatactagggatttgattttaagatctttattcaaattttttgcgcttaacaaacagcagccagtcccacccaagtctgtttcaaatgtctcgtaactaaaatcatcttgcaatttctttttgaaactgtcaatttgctcttgagtaatgtctcttcgtaacaaagtcaaagagcaaccgccgccaccagcaccggtaagttttgtggagccaattctcaaatcatcgctcagatttttaataagttctaatccaggatgagaaacaccgattgagacaagcagtccatgatttattcttatcaattccaatagttgttcatacagttcattattagtttctacagcctcgtcatcggtgcctttacatttacttaacttagtcatgatctctaagccttgtagggcacattcacccatggcatctagaattggcttcataacttcaggaaatttctcggtgaccaacacacgaacgcgagcaacaagatcttttgtagaccttggaattctagtataggttaggatcattggaatggctgggaaatcatctaagaacttaaaattgtttgtgtttattgttccattatgtgagtctttttcaaatagcagggcattaccataagtggccacagcgttatctattcctgaaggggtaccgtgaatacacttttcacctatgaaggcccattgattcactatatgcttatcgttttctgacagcttttccaagtcattagatcctattaacccccccaagtaggccatagctaaggccagtgatacagaaatagaggcgcttgagcccaacccagcaccgatgggtaaagtagactttaaagaaaacttaatattcttggcatgggggcataggcaaacaaacatatacaggaaacaaaacgctgcatggtagtggaaggattcggatagttgagctaacaacggatccaaaagactaacgagttcctgagacaagccatcggtggcttgttgagccttggccaatttttgggagtttacttgatcctcggtgatggcattgaaatcattgatggaccacttatgattaaagctaatgtccgggaagtccaattcaatagtatctggtgcagatgactcgcttattagcaggtaggttctcaacgcagacacactagcagcgacggcaggcttgttgtacacagcagagtgttcaccaaaaataataacctttcccggtgcagaagttaagaacggtaatgacatcggtgtttaaaccccagcgcctggcggg

SEQ ID NO: 146 - DNA, 6042 bp, Artificial Sequence
  Phase III marker recycling construct nucleotide sequence
gacggcacggccacgcgtttaaaccgccaaaagtgcagctcagagcccccagcaccagtattagaggtcataatgggctgcgaagcctgctaaaatgcagtggaggccgtgtaccctttgccaaattggctattggaatcggcagagaacctgggtcccgttctagagaccctgcgagcgtgtcccggtgggttctgggagctctaactccgcaggaactacaaaccttgcttacacagagtgaacctgctgcctggcgtgctctgactcagtacatttcatagcccatcttcaacaacaataccgacttaccatcctatttgctttgccctttttcttttccactgcactttgcatcggaaggcgttatcggttttgggtttagtgcctaaacgagcagcgagaacacgaccacgggctatataaatggaaagttaggacaggggcaaagaataagagcacagaagaagagaaaagacgaaaagcagaagcggaaaacgtatacacgtcacatatcacacacacacgctcacacgcggccagggggagcctcactattattccataagatgatcattagcattacgttcaaaacgagtacaaataacttaagtaataacacgagccatatgaccattagcaagatgacaagcaagttaagaccaatcagcttccatcatagcatcagcttaacgttcaccattaataagagtagaaatttcaccttcaagacaataacgattttcgtggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcactcttcgcaatgtcaacagtacccttagtatattctccagtagctagggagcccttgcatgacaattctgctaacatcaaaaggcctctaggttcctttgttacttcttccgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacaccacatatgcgtatatataccaatctaagtctgtgctccttccttcgttcttccttctgctcggagattaccgaatcaaaaaaatttcaaagaaaccggaatcaaaaaaaagaacaaaaaaaaaaaagatgaattgaaaagctttatggaccctgaaaccactcactattattccataagatgatcattagcattacgttcaaaacgagtacaaataacttaagtaataacacgagccatatgaccattagcaagatgacaagcaagttaagaccaatcagcttccatcatagcatcagcttaacgttcaccattaataagagtagaaatttcaccttcaagacaataacgattttcgtgcgctcgtccaacgccggcggacctgacggtagcaacaagaatatagcacgagccgcggagttcatttcgttacttttgatatcactcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcattagatatattttctgtcattttccttaacccaaaaataagggaaagggtccaaaaagcgctcggacaactgttgaccgtgatccgaaggactggctatacagtgttcacaaaatagccaagctgaaaataatgtgtagctatgttcagttagtttggctagcaaagatataaaagcaggtcggaaatatttatgggcattattatgcagagcatcaacatgataaaaaaaaacagttgaatattccctcaaaaatccccgcgtgcttggccggccgtaattaataatgtcaactttgcctatttcttctgtgtcattttcctcttctacatcaccattagtcgtggacgacaaagtctcaaccaagcccgacgttatcagacatacaatgaatttcaatgcttctatttggggagatcaattcttgacctatgatgagcctgaagatttagttatgaagaaacaattagtggaggaattaaaagaggaagttaagaaggaattgataactatcaaaggttcaaatgagcccatgcagcatgtgaaattgattgaattaattgatgctgttcaacgtttaggtatagcttaccattttgaagaagagatcgaggaagctttgcaacatatacatgttacctatggtgaacagtgggtggataaggaaaatttacagagtatttcattgtggttcaggttgttgcgtcaacagggctttaacgtctcctctggcgttttcaaagactttatggacgaaaaaggtaaattcaaagagtctttatgcaatgatgcacaaggaatattagccttatatgaagctgcatttatgagggttgaagatgaaaccatcttagacaatgctttggaattcacaaaagttcatttagatatcatagcaaaagacccatcttgcgattcttcattgcgtacacaaatccatcaagccttaaaacaacctttaagaaggagattagcaaggattgaagcattacattacatgccaatctaccaacaggaaacatctcatgatgaagtattgttgaaattagccaagttggatttcagtgttttgcagtctatgcataaaaaggaattgtcacatatctgtaagtggtggaaagatttagatttacaaaataagttaccttatgtacgtgatcgtgttgtcgaaggctacttctggatattgtccatatactatgagccacaacacgctagaacaagaatgtttttgatgaaaacatgcatgtggttagtagttttggacgatacttttgataattatggaacatacgaagaattggagatttttactcaagccgtcgagagatggtctatctcatgcttagatatgttgcccgaatatatgaaattaatctaccaagaattagtcaatttgcatgtggaaatggaagaatctttggaaaaggagggaaagacctatcagattcattacgttaaggagatggctaaagaattagttcgtaattacttagtagaagcaagatggttgaaggaaggttatatgcctactttagaagaatacatgtctgtttctatggttactggtacttatggtttgatgattgcaaggtcctatgttggcagaggagacattgttactgaagacacattcaaatgggtttctagttacccacctattattaaagcttcctgtgtaatagtaagattaatggacgatattgtatctcacaaggaagaacaagaaagaggacatgtggcttcatctatagaatgttactctaaagaatcaggtgcttctgaagaggaagcatgtgaatatattagtaggaaagttgaggatgcctggaaagtaatcaatagagaatctttgcgtccaacagccgttcccttccctttgttaatgccagcaataaacttagctagaatgtgtgaggtcttgtactctgttaatgatggttttactcatgctgagggtgacatgaaatcttatatgaagtccttcttcgttcatcctatggtcgtttgagctagctaagatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaagaacctgcaggccgcgagcgccgatcttgtgctaagtggtgctgttagacagctacgaataaggaaattccgaagcatgtagggaggtcatgatatgaaaaagcaaaagagtaggcatcaaaaagtttctcattcaagtggtaactgctgttaaaattaagatatttataaattgaagcttggtcgttccgaccaataccgtagggaaacgtaaattagctattgtaaaaaaaggaaaagaaaagaaaagaaaaatgttacatatcgaattgatcttattcctttggtagaccagtctttgcgtcaatcaaagattcgtttgtttcttgtgggcctgaaccgacttgagttaaaatcactctggcaacatccttttgcaactcaagatccaattcacgtgcagtaaagttagatgattcaaattgatggttgaaagcctcaagctgctcagtagtaaatttcttgtcccatccaggaacagagccaaacaatttatagataaatgcaaagagtttcgactcattttcagctaagtagtacaacacagcatttggacctgcatcaaacgtgtatgcaacgattgtttctccgtaaaactgattaatggtgtggcaccaactgatgatacgcttggaagtgtcattcatgtagaatattggagggaaagagtccaaacatgtggcatggaaagagttggaatccatcattgtttcctttgcaaaggtggcgaaatctttttcaacaatggctttacgcatgacttcaaatctctttggtacgacatgttcaattctttctttaaatagttcggaggttgccacggtcaattgcataccctgagtggaactcacatcctttttaatatcgctgacaactaggacacaagctttcatctgaggccagtcagagctgtctgcgatttgtactgccatggaatcatgaccatcttcagcttttcccatttcccaggccacgtatccgccaaacaacgatctacaagctgaaccagacccctttcttgctattctagatatttctgaagttgactgtggtaattggtataacttagcaattgcagagaccaatgcagcaaagccagcagcggaggaagctaaaccagctgctgtaggaaagttattttcggagacaatgtggagtttccattgagataatgtgggcaatgaggcgtccttcgattccatttcctttcttaattggcgtaggtcgcgcagacaattttgagttctttcattgtcgatgctgtgtggttctccatttaaccacaaagtgtcgcgttcaaactcaggtgcagtagccgcagaggtcaacgttctgaggtcatcttgcgataaagtcactgatatggacgaattggtgggcagattcaacttcgtgtcccttttcccccaatacttaagggttgcgatgttgacgggtgcggtaacggatgctgtgtaaacggtcatcggtgtttaaaccccagcgcctggcggg

SEQ ID NO: 147 - DNA, 5213 bp, Artificial Sequence
  STE5 disruption construct nucleotide sequence
gacggcacggccacgcgtttaaaccgccacgaagtgactgacagaatactgacatcagctgatttctcatagagctgtttctctgataacacgttgtttgaacatcgacaagatgaaaatctagaagtatcaagtttcctttaaagggatatataacagattctaaaactgacagaaatatttcgagtgaagaagaagcgttaaatattggatctttccgcagttctactctgatacatttttgaagtaggagagtcatttagaaggcgtattgctcaatagtagaaagcaggcctgtgcacatgaattaattaaaaaatataaaggtagtgattagacgacacatgtccataggtaacctgtcataattttgaacaatttcccttcttttcttttttttttttgggtgcggcgatatgtagcttgttaatttacacatcatgtacttttctgcatcaaaatatgaaaggcgatagtagctaaagaaaataccgagaatttcctcgaaaagttgacgacaaaagaaaggcataaaaaagtaatttgaaaatattttaaaactgttttaacccatctagcatccgcgctaaaaaaggaagatacaggatacagcggaaacaacttttaagctcacacgcggccagggggagccatgcgtccatctttacagtcctgtcttattgttcttgatttgtgccccgtaaaatactgttacttggttctggcgaggtattggatagttcctttttataaaggccatgaagctttttctttccaattttttttttttcgtcattatagaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagctagggagcccttgcatgacaattctgctaacatcaaaaggcctctaggttcctttgttacttcttccgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacaccacatatgcgtatatataccaatctaagtctgtgctccttccttcgttcttccttctgctcggagattaccgaatcaaaaaaatttcaaagaaaccggaatcaaaaaaaagaacaaaaaaaaaaaagatgaattgaaaagctttatggaccctgaaaccacagccacattaaccttctttgatggtcaaaacttatccttcaccataaatatgcctcgcaaaaaaggtaattaacatatatagaattacattatttatgaaatatcatcactatctcttagcatctttaatccttttctacatcagataacttcggtttgttatcatcgtctgtattgtcatcaattggcgcagtagcctcaatttcaacgtcgtttgactctggtgtttgttcatgtgcagatccatgagatgatgaaccgctcgtccaacgccggcggacctcttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaattaataatggctgcagaccaattggtgaagactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaagggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgtcgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccacatgctaccgctcctggtaccaacgcacgtcaattagcaagaatagttgcctgtgccgtcttggcaggtgaattatccttatgtgctgccctagcagccggccatttggttcaaagtcatatgacccacaacaggaaacctgctgaaccaacaaaacctaacaatttggacgccactgatataaatcgtttgaaagatgggtccgtcacctgcattaaatcctaaacttagtcatacgtcattggtattctcttgaaaaagaagcacaacagcaccatgtgttacgtaaaatatttactttatagtttgtacgtcataatttcttccatattacaagttcgtgcatatatagaaagaattctgttgttgtaattgtcataactaacctgcaggccgcgagcgccgatagtatacactaaattttatgcaataataaaaagaaagcatcccgccaaacgtttcgtaactacatattgttacatagtttgattccgtgaatttgaagtggacgcagttcttcttagtctttcaagttcatagtaaatagacattacccaaagatctctttcctgtcttgatcttgccatgaaaaccattgacttgccgctcacacctaactttttagtgaaatggatcttatctgtgttacttggaacattagagttattcaagtcagcttccggagcagaaggtgggtcaatattattatcttgtctaccataatcttgcgtatattgcttttcattccctttcttctgtaagcgattgctagaaagggcacgccttgttccaaaccaaagcgtaaagcatcgcgaactctcgtcttctacagatcgccatccgtccccataaactcgtgggagagcgtgggatccatagtttatttcgtcaaaagtacgatctctctgcagaaggtctagttctgttgtggtcccagagtataggtagcaatcgtcaatcggaatggttacataatgagcatactccaaaacttccttagcaaaacccggtgtttaaaccccagcgcctggcggg

SEQ ID NO: 148 - DNA, 5417 bp, Artificial Sequence
  IME1 disruption construct nucleotide sequence
gacggcacggccacgcgtttaaaccgccatccaattcctctattatatgcatacatttttttgtttgattatctatgctgtttataatatcgtatatagttaatgaataaccctacaacacgaagggcagtaatatattctgattctcagttgaaatttcaaatttttcaagctggtcttactcggcaggtaggaacttcccagtgggtctgagttttctctccggaaggtatttatcattatgcacgacaagtgcgattcaatcgaaagattataaatttcgcgatgaacaacatctgataaaaaaaaaattaaaaaacaataatctaaatgatatgtatgggttaaaaaggatgtatggatggagggttggcataaaaatgaaaggcagaagatgggcggctaaaaaggtatagagatcgtacgtcaccgtcacaaaaatcactcatagaatgcactatcatccttacaataccataccagccgcaagaaaaaaagaaaaaaaaatcaattcatatcatatattatctatatcatgctgttctttccgccacgctcacacgcggccagggggagcccgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgcctcgctcgtccaacgccggcggacctcttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaattaataatgtcaactttgcctatttcttctgtgtcattttcctcttctacatcaccattagtcgtggacgacaaagtctcaaccaagcccgacgttatcagacatacaatgaatttcaatgcttctatttggggagatcaattcttgacctatgatgagcctgaagatttagttatgaagaaacaattagtggaggaattaaaagaggaagttaagaaggaattgataactatcaaaggttcaaatgagcccatgcagcatgtgaaattgattgaattaattgatgctgttcaacgtttaggtatagcttaccattttgaagaagagatcgaggaagctttgcaacatatacatgttacctatggtgaacagtgggtggataaggaaaatttacagagtatttcattgtggttcaggttgttgcgtcaacagggctttaacgtctcctctggcgttttcaaagactttatggacgaaaaaggtaaattcaaagagtctttatgcaatgatgcacaaggaatattagccttatatgaagctgcatttatgagggttgaagatgaaaccatcttagacaatgctttggaattcacaaaagttcatttagatatcatagcaaaagacccatcttgcgattcttcattgcgtacacaaatccatcaagccttaaaacaacctttaagaaggagattagcaaggattgaagcattacattacatgccaatctaccaacaggaaacatctcatgatgaagtattgttgaaattagccaagttggatttcagtgttttgcagtctatgcataaaaaggaattgtcacatatctgtaagtggtggaaagatttagatttacaaaataagttaccttatgtacgtgatcgtgttgtcgaaggctacttctggatattgtccatatactatgagccacaacacgctagaacaagaatgtttttgatgaaaacatgcatgtggttagtagttttggacgatacttttgataattatggaacatacgaagaattggagatttttactcaagccgtcgagagatggtctatctcatgcttagatatgttgcccgaatatatgaaattaatctaccaagaattagtcaatttgcatgtggaaatggaagaatctttggaaaaggagggaaagacctatcagattcattacgttaaggagatggctaaagaattagttcgtaattacttagtagaagcaagatggttgaaggaaggttatatgcctactttagaagaatacatgtctgtttctatggttactggtacttatggtttgatgattgcaaggtcctatgttggcagaggagacattgttactgaagacacattcaaatgggtttctagttacccacctattattaaagcttcctgtgtaatagtaagattaatggacgatattgtatctcacaaggaagaacaagaaagaggacatgtggcttcatctatagaatgttactctaaagaatcaggtgcttctgaagaggaagcatgtgaatatattagtaggaaagttgaggatgcctggaaagtaatcaatagagaatctttgcgtccaacagccgttcccttccctttgttaatgccagcaataaacttagctagaatgtgtgaggtcttgtactctgttaatgatggttttactcatgctgagggtgacatgaaatcttatatgaagtccttcttcgttcatcctatggtcgtttgagctagctaagatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaagaacctgcaggccgcgagcgccgatctcgaaaagtactacaatcttcccccttccctcaaaatatatccattcacactcatttctttatttccattgtctcactcaaattgctaagaatttgtgtatttgcatatatatatattatatataggtatatatatgtattcaatgtctcaagctccatgacataataccgtagcgttattagccttatcgtatgtcgcgatgggaaaggagattcgttttaatcttgaaaaaccttcgtagcgaataatgcgacataaatcttgagagagtacatcaccaaattcactttgttaaaccgcaccatcgtgctttgcattcttattccttttgcctacactaaaattattagcatttctctaaatgagctccagtgaagacgaagacgacaagttcttgtatggttccgactccgaattagcactaccttcatctaaacgatcaagagatgatgaagcagacgcaggtgcgtccagtaatcctgatatagttaaaaggcaaacggtgtttaaaccccagcgcctggcggg

SEQ ID NO: 149 - DNA, 9492 bp, Artificial Sequence
  Plasmid pAM1124 nucleotide sequence
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaaatgaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgccggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctgagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatcttaacttgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgagagatgtatgaaagaaagtgcgtagaataacgaacattcatagctgttctggaggctttacaaaaggtaatctttgttaggtgcgattttatccgaaaagcaattactctctatgttagtcatacaaactgacttctgtgagagaattattttcatatcaacgtaagatcacatggttcctttatcaagtactactatcattccattatatgacctatttacttcttgaatcttagagctcataattcaagcaagttgcggagctaagaatttcacatgttgttgaacttaacaatcttcattatacccaatcgctgcgtgctggaattatgttaaaagttacatcctttttttcatttttccctacgctcagggcactgtactgcccgtgcctgcgatgagatacatcaatttaaaaaaaaaaccagcatgctataatgctggagcaaaaatttcaatcagaaatagaaaagacctcaacagtaattaacccaaaggggtatcaaataatcgatgtgctttttcactctacgaatgatctgtgagaaactgatttgggccgaatcgcgtaaaaagtttgattcgtggcggctaatgtctgaggggctccaacaggctcgtagagcctcgtttcttgagggcacaaaatgtccaggtaatattcccaagaaagaaccgcagagtgctttgataaatcggttacaggtcttaacgtaggttttgtctcgctaattgctattgagtaagttcgatccgtttggcgtcttttggggtgtaacgccaaacttattacttttcctatttgaggttggtattgattgttgtcaaagaatgaaaatatacacaaacgccacaatatacgtaccaggttcacgaaaactgatcgtatggttcataccctgacttggcaaacctaatgtgaccgtcgctgattagcggatcacgaaaagtgatctcgatacaattagaggatccacgaaaatgatgtgaatgaatacatgaaagattcatgagatctgacaacatggtagacgtgtgtgtctcatggaaattgatgcagttgaagacatgtgcgtcacgaaaaaagaaatcaatcctacacagggcttaagggcaaatgtattcatgtgtgtcacgaaaagtgatgtaactaaatacacgattaccatggaaattaacgtaccttttttgtgcgtgtattgaaatattatgacatattacagaaagggttcgcaagtcctgtttctatgcctttctcttagtaattcacgaaataaacctatggtttacgaaatgatccacgaaaatcatgttattatttacatcaacatatcgcgaaaattcatgtcatgtccacattaacatcattgcagagcaacaattcattttcatagagaaatttgctactatcacccactagtactaccattggtacctactactttgaattgtactaccgctgggcgttattaggtgtgaaaccacgaaaagttcaccataacttcgaataaagtcgcggaaaaaagtaaacagctattgctactcaaatgaggtttgcagaagcttgttgaagcatgatgaagcgttctaaacgcactattcatcattaaatatttaaagctcataaaattgtattcaattcctattctaaatggcttttatttctattacaactattagctctaaatccatatcctcataagcagcaatcaattctatctatactttaaaatgctttctgaaaacacgactattctgatggctaacggtgaaattaaagacatcgcaaacgtcacggctaactcttacgttatgtgcgcagatggctccgctgcccgcgtcataaatgtcacacagggctatcagaaaatctataatatacagcaaaaaaccaaacacagagcttttgaaggtgaacctggtaggttagatcccaggcgtagaacagtttatcagcgtcttgcattacaatgtactgcaggtcataaattgtcagtcagggtccctaccaaaccactgttggaaaaaagtggtagaaatgccaccaaatataaagtgagatggagaaatctgcagcaatgtcagacgcttgatggtaggataataataattccaaaaaaccatcataagacattcccaatgacagttgaaggtgagtttgccgcaaaacgcttcatagaagaaatggagcgctctaaaggagaatatttcaactttgacattgaagttagagatttggattatcttgatgctcaattgagaatttctagctgcataagatttggtccagtactcgcaggaaatggtgttttatctaaatttctcactggacgtagtgaccttgtaactcctgctgtaaaaagtatggcttggatgcttggtctgtggttaggtgacagtacaacaaaagagccagaaatctcagtagatagcttggatcctaagctaatggagagtttaagagaaaatgcgaaaatctggggtctctaccttacggtttgtgacgatcacgttccgctacgtgccaaacatgtaaggcttcattatggagatggtccagatgaaaacaggaagacaaggaatttgaggaaaaataatccattctggaaagctgtcacaattttaaagtttaaaagggatcttgatggagagaagcaaatccctgaatttatgtacggcgagcatatagaagttcgtgaagcattcttagccggcttgatcgactcagatgggtacgttgtgaaaaagggcgaaggccctgaatcttataaaatagcaattcaaactgtttattcatccattatggacggaattgtccatatttcaagatctcttggtatgtcagctactgtgacgaccaggtcagctagggaggaaatcattgaaggaagaaaagtccaatgtcaatttacatacgactgtaatgttgctgggggaacaacttcacagaatgttttgtcatattgtcgaagtggtcacaaaacaagagaagttccgccaattataaaaagggaacccgtatatttcagcttcacggatgatttccagggtgagagtactgtatatgggcttacgatagaaggccataaaaatttcttgcttggcaacaaaatagaagtgaaatcatgtcgaggctgctgtgtgggagaacagcttaaaatatcacaaaaaaagaatctaaaacactgtgttgcttgtcccagaaagggaatcaagtatttttataaagattggagtggtaaaaatcgagtatgtgctagatgctatggaagatacaaattcagcggtcatcactgtataaattgcaagtatgtaccagaagcacgtgaagtgaaaaaggcaaaagacaaaggcgaaaaattgggcattacgcccgaaggtttgccagttaaaggaccagagtgtataaaatgtggcggaatcttacagtttgatgctgtccgcgggcctcataagagttgtggtaacaacgcaggtgcgcgcatctgctaaaatgtgtatattagtttaaaaagttgtatgtaataaaagtaaaatttaatattttggatgaaaaaaaccatttttagactttttcttaactagaatgctggagtagaaatacgccatctcaagatacaaaaagcgttaccggcactgatttgtttcaaccagtatatagattattattgggtcttgatcaactttcctcagacatatcagtaacagttatcaagctaaatatttacgcgaaagaaaaacaaatattttaattgtgatacttgtgaattttattttattaaggatacaaagttaagagaaaacaaaatttatatacaatataagtaatattcatatatatgtgatgaatgcagtcttaacgagaagacatggccttggtgacaactctcttcaaaccaacttcagcctttctcaattcatcagcagatgggtcttcgatttgcaaagcagccaaagcatcggacaaagcagcttcaatcttggacttggaacctctcttcaatttagaagacaagactgggtcagtgacagtttgttcgatggaggcaacgtaggattccaatctttgtctagcttcgtgcttcttggcaaaagcttcatcggcagccttgaactcttcagcttggttaaccatcttttcaatttcttcagaagacaatctaccaacagcgttagagatagtgatgttagaagacttaccggtagacttttcgacggcagtaaccttcaagataccgttagcatcaacttcgaagatagcttccaagactggttcaccagctggcatcattgggatgttcttcaagtcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 150 - DNA, 8845 bp, Artificial Sequence
  Plasmid pAM1758 nucleotide sequence
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaaatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatcttaacttgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgaccaagtcaatggttttcatggcaagatcaagacaggaaagagatctttgggtaatgtctatttactatgaacttgaaagactaagaagaactgcgtccacttcaaattcacggaatcaagctatgtaacaatatatagttaagaaacgtttggcgggatgcttcctttttattattgcataaaatttagtgtatactctatatataatccatatggaggggacagttgttattaccgctctctataagactcgagaatgaactgcgtctggttatgccatcgattcctttatccatatcactaagtaataatactggcatatcattttcattttcattttcattagtaccctcctcctcagaatgaagtgaaaatctaatattaggaatcagagctggctgtactgaagaagcgacagtttctaagttttctatattgctatgttcaccctcagtgagaaggtttctgtcattcaccatatttgcggtagcattttcattatcaaatggagagtcaatatgaatagtggttgtagattcagcatccgacagtaatcctgaactattatcaagttcattatcggtcgaatcatcattatcctcttcgtcatcgtcatcatcttcatcaaaacttagaccgaaactgtagcaaagagtttctaaaacaaaagtccaggagctggcctcgactagttcatcaattttatcactgtagtcaacgttcaaatagcccaccttaatcttcaattcattgggccttcttcttccaaaacttgtaaagcatctgtaatcttgaaatagtacggatttttttgcttccatattactatttgatacagcaacaatacccaaatgttcatgaatattttcgggatatagagtatttttcagccaaataggtgaaaattgtgtcgaggaactctttgatttgagatttgagatggaatctagtgaatctatcttgtgtaataccgatccatagtccagaacataattatttcgatcaacgaaacaaaactgcaaacgcgcaaatttaatggttaaagcttttaggctgttataaataacaattaaactgtcttcttccttcaatttcgtaaagtcaatctgtaagattattgccaaattatcaggtttttctcgttttaaggaaagaattgagcttatcgtagttagaacagattgtatactgtcaacagtactctgcctagaacattctcctgaatttaaggtgaatcccctccttatgattacagtatcattatcgtgcacatttgcaacttcaacaactttgttaggattgattaaacctagaaaggtactcgtctcgtacctaccattaccaacatcttttgaaaagttctttataatgggaagaataggcagggtggaagtgatattgtcctcattgaatacaaaatcctgattcaatataccagatatccatttctgtacagttgtgctttcgtcagaatttatattctgaacaatgtaaagatctgataaatcggcgcaatgttgtttatttaaggtgcatttgagtactgaagcttcgagtgtagtcattctcaagttggcaataggtgtaaatacttctaaattctttagtctagtttccaaaacatcaacatcgttatccacttctgctattacaaatgcgtcttcaaataagaaacaccagcattgtatatatctctgaccatctttggaaatcatcaatttgtctaccaaccttagtaatccatagtccccgtctattctccaatcctgcaattcttcctggaaattgttcaaaagaatttgaataaaatatgaccttaacagcggcaacgttattttggtttcgtcatcctttgctcttaccgaattggaaacagcagaaatagaatcattagctgataacgctacagaggtgtctgctaagatagagtttgctccggacggaattcttctgtgccccaggggtgaatgtaaaaatgtatagtttgattttttttgtggaatttggtttctttccttggggggtgcagccaatatgagatttgggtttagacttggagcttgagaatatatcgtttgtctttcaacaggtgtataggataaaccaaaaggaggcaagagtggtgaataaggaggaaagcgggactgaggtgtgattgataactcagaatcaggaatcttatgaatcaaaaaatcagaaattagaatatcctttagttcatcattttctggaatgcattgaacggctttgttagtatcttttttacatttggtacaaaaaggaaatagcgcacgaacgtctgcctttgaagtggtgccaaaagagataataagacattcttggtgacttaagtggccacatgcaagctctataattttctctccctttcttctgttagaaataggctcgtcacataacgtacaagaagcattcaaaaaggattttttaatagaggttctttgtattggatagccaaatggagcgaccttgggtggtatattatctgataaattttcggcccttggaggctcatttgctcgggataggttactattacttgcgtgaaagagattggaattaggtcttggcaaagacgatgttctgtgagggtgttgtggtaaataatcagtggaaaccgtagaaggtgtattcattagattaccgtcttcattgccagaagagtttgaagaagtgaccctagatttgggtgagaacgaaaatgtagaggaggaaataggagaaggtgagaatcttttctttttagcactacttctttggaacctggctaacttttccgtccatttttttcctcttgacaatggagatagagtgctgggcttctctagctctattatttggttgggcgttctcgacaaggtaccactatattgtgtcgagctaccaaaattgtgaaaaggggaaactatattgtctgtaggagtttccatcatttaaaagttgtttccgctgtatcctgtatcttccttttttagcgcggatgctagatgggttaaaacagttttaaaatattttcaaattacttttttatgcctttcttttgtcgtcaacttttcgaggaaattctcggtattttctttagctactatcgcctttcatattttgatgcagaaaagtacatgatgtgtaaattaacaagctacatatcgccgcacccaaaaaaaaaaaaagaaaaaaagggaaattgttcaaaattatgacaggttacctatggacatgtgtcgtctaatcactacctttatattttttaattaattcatgtgcacaggcctgctttctactattgagcaatacgccttctaaatgactctcctacttcaaaaatgtatcagagtagaactgcggaaagatccaatatttaacgcttcttcttcactcgaaatatttctgtcagttttagaatctgttatatatccctttaaaggaaacttgatgcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 151 - DNA, 1761 bp, Saccharomyces cerevisiae
ttagcagatgcgcgcacctgcgttgttaccacaactcttatgaggcccgcggacagcatcaaactgtaagattccgccacattttatacactctggtcctttaactggcaaaccttcgggcgtaatgcccaatttttcgcctttgtcttttgcctttttcacttcacgtgcttctggtacatacttgcaatttatacagtgatgaccgctgaatttgtatcttccatagcatctagcacatactcgatttttaccactccaatctttataaaaatacttgattccctttctgggacaagcaacacagtgttttagattctttttttgtgatattttaagctgttctcccacacagcagcctcgacatgatttcacttctattttgttgccaagcaagaaatttttatggccttctatcgtaagcccatatacagtactctcaccctggaaatcatccgtgaagctgaaatatacgggttccctttttataattggcggaacttctcttgttttgtgaccacttcgacaatatgacaaaacattctgtgaagttgttcccccagcaacattacagtcgtatgtaaattgacattggacttttcttccttcaatgatttcctccctagctgacctggtcgtcacagtagctgacataccaagagatcttgaaatatggacaattccgtccataatggatgaataaacagtttgaattgctattttataagattcagggccttcgccctttttcacaacgtacccatctgagtcgatcaagccggctaagaatgcttcacgaacttctatatgctcgccgtacataaattcagggatttgcttctctccatcaagatcccttttaaactttaaaattgtgacagctttccagaatggattatttttcctcaaattccttgtcttcctgttttcatctggaccatctccataatgaagccttacatgtttggcacgtagcggaacgtgatcgtcacaaaccgtaaggtagagaccccagattttcgcattttctcttaaactctccattagcttaggatccaagctatctactgagatttctggctcttttgttgtactgtcacctaaccacagaccaagcatccaagccatactttttacagcaggagttacaaggtcactacgtccagtgagaaatttagataaaacaccatttcctgcgagtactggaccaaatcttatgcagctagaaattctcaattgagcatcaagataatccaaatctctaacttcaatgtcaaagttgaaatattctcctttagagcgctccatttcttctatgaagcgttttgcggcaaactcaccttcaactgtcattgggaatgtcttatgatggttttttggaattattattatcctaccatcaagcgtctgacattgctgcagatttctccatctcactttatatttggtggcatttctaccacttttttccaacagtggtttggtagggaccctgactgacaatttatgacctgcagtacattgtaatgcaagacgctgataaactgttctacgcctgggatctaacctaccaggttcaccttcaaaagctctgtgtttggttttttgctgtatattatagattttctgatagccctgtgtgacatttatgacgcgggcagcggagccatctgcgcacataacgtaagagttagccgtgacgtttgcgatgtctttaatttcaccgttagccatcagaatagtcgtgttttcagaaagcat

SEQ ID NO: 152 - protein, 586 aa, Saccharomyces cerevisiae
MLSENTTILMANGEIKDIANVTANSYVMCADGSAARVINVTQGYQKIYNIQQKTKHRAFEGEPGRLDPRRRTVYQRLALQCTAGHKLSVRVPTKPLLEKSGRNATKYKVRWRNLQQCQTLDGRIIIIPKNHHKTFPMTVEGEFAAKRFIEEMERSKGEYFNFDIEVRDLDYLDAQLRISSCIRFGPVLAGNGVLSKFLTGRSDLVTPAVKSMAWMLGLWLGDSTTKEPEISVDSLDPKLMESLRENAKIWGLYLTVCDDHVPLRAKHVRLHYGDGPDENRKTRNLRKNNPFWKAVTILKFKRDLDGEKQIPEFMYGEHIEVREAFLAGLIDSDGYVVKKGEGPESYKIAIQTVYSSIMDGIVHISRSLGMSATVTTRSAREEIIEGRKVQCQFTYDCNVAGGTTSQNVLSYCRSGHKTREVPPIIKREPVYFSFTDDFQGESTVYGLTIEGHKNFLLGNKIEVKSCRGCCVGEQLKISQKKNLKHCVACPRKGIKYFYKDWSGKNRVCARCYGRYKFSGHHCINCKYVPEAREVKKAKDKGEKLGITPEGLPVKGPECIKCGGILQFDAVRGPHKSCGNNAGARIC

SEQ ID NO: 153 - DNA, 8987 bp, Artificial Sequence
  Plasmid pAM404 nucleotide sequence
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctgaattggagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttatttagaagtgtcaacaacgtatctaccaacgatttgacccttttccatcttttcgtaaatttctggcaaggtagacaagccgacaaccttgattggagacttgaccaaacctctggcgaagaattgttaattaagagctcagatcttatcgtcgtcatccttgtaatccatcgatactagtgcggccgccctttagtgagggttgaattcgaattttcaaaaattcttactttttttttggatggacgcaaagaagtttaataatcatattacatggcattaccaccatatacatatccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggtgacagccctccgaaggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaaccccggatccatgtcaactttgcctatttcttctgtgtcattttcctcttctacatcaccattagtcgtggacgacaaagtctcaaccaagcccgacgttatcagacatacaatgaatttcaatgcttctatttggggagatcaattcttgacctatgatgagcctgaagatttagttatgaagaaacaattagtggaggaattaaaagaggaagttaagaaggaattgataactatcaaaggttcaaatgagcccatgcagcatgtgaaattgattgaattaattgatgctgttcaacgtttaggtatagcttaccattttgaagaagagatcgaggaagctttgcaacatatacatgttacctatggtgaacagtgggtggataaggaaaatttacagagtatttcattgtggttcaggttgttgcgtcaacagggctttaacgtctcctctggcgttttcaaagactttatggacgaaaaaggtaaattcaaagagtctttatgcaatgatgcacaaggaatattagccttatatgaagctgcatttatgagggttgaagatgaaaccatcttagacaatgctttggaattcacaaaagttcatttagatatcatagcaaaagacccatcttgcgattcttcattgcgtacacaaatccatcaagccttaaaacaacctttaagaaggagattagcaaggattgaagcattacattacatgccaatctaccaacaggaaacatctcatgatgaagtattgttgaaattagccaagttggatttcagtgttttgcagtctatgcataaaaaggaattgtcacatatctgtaagtggtggaaagatttagatttacaaaataagttaccttatgtacgtgatcgtgttgtcgaaggctacttctggatattgtccatatactatgagccacaacacgctagaacaagaatgtttttgatgaaaacatgcatgtggttagtagttttggacgatacttttgataattatggaacatacgaagaattggagatttttactcaagccgtcgagagatggtctatctcatgcttagatatgttgcccgaatatatgaaattaatctaccaagaattagtcaatttgcatgtggaaatggaagaatctttggaaaaggagggaaagacctatcagattcattacgttaaggagatggctaaagaattagttcgtaattacttagtagaagcaagatggttgaaggaaggttatatgcctactttagaagaatacatgtctgtttctatggttactggtacttatggtttgatgattgcaaggtcctatgttggcagaggagacattgttactgaagacacattcaaatgggtttctagttacccacctattattaaagcttcctgtgtaatagtaagattaatggacgatattgtatctcacaaggaagaacaagaaagaggacatgtggcttcatctatagaatgttactctaaagaatcaggtgcttctgaagaggaagcatgtgaatatattagtaggaaagttgaggatgcctggaaagtaatcaatagagaatctttgcgtccaacagccgttcccttccctttgttaatgccagcaataaacttagctagaatgtgtgaggtcttgtactctgttaatgatggttttactcatgctgagggtgacatgaaatcttatatgaagtccttcttcgttcatcctatggtcgtttgagctagctaagatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaagatccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 154 - DNA, 746 bp, Artificial Sequence
  URA3 knockout construct nucleotide sequence
tgcgaggcatatttatggtgaaggataagttttgaccatcaaagaaggttaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacggctcacacgcggccagggggagccctgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggcctttataaaaaggaactatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttgtactctaatctggtagaaagatgtttcacagactgtgtcaatgacttcacaacatcaaagctaaccaataaggaacaaacatgcatcatgaagtgctcagaaaagttcttgaagc

SEQ ID NO: 155 - DNA, 4961 bp, Saccharomyces cerevisiae
tgggataggatagtagcaactcttggaggagagcattgtcagttgtccagtctctgaagttaagtagtaagtttgcggagtcaaagggggatggcttttgccatttgtgagagttgtgcggcagcatcttattcaaatagagctgtattctgaagacctcttgtagaacatcatccatactaaaaagtaaatcgtcctgtcccattacgagctgtattagtgctgtgaccctctgtatatttacgttgccatgaagaaggtaatgggcgatattttgatacaattcctgagttgcatgttggattgagtttacgaagggtcgccagacggccagaaacctccaggcggagttaacaactagtaatacggcatccatgtttgcatcagcgccgagcctataccagtcactgagtagacgttttcttgctctttttatgtcctgacttcttttgacgagggggcattctctagagacacaggcagttgcttccagcaactgccgtacggccgttctcatgctgtcgaggattttttttgggacgatattgtcattatagggcagtgtgtgacttatgaattgttgtagaaggacgtctgtgatgttggagatatgtattttgttaactcttcttgagacgatttggccctggatagcgaagcgtgcggttacaaataggtcgtcttgttcaagaaggtaggcgaggacattatctatcagtacaaacatcttagtagtgtctgaggagagggttgattgtttatgtatttttgcgaaatatatatatatatattctacacagatatatacatatttgtttttcgggctcattctttcttctttgccagaggctcaccgctcaagaggtccgctaattctggagcgattgttattgttttttcttttcttcttctattcgaaacccagtttttgatttgaatgcgagataaactggtattcttcattagattctctaggcccttggtatctagatatgggttctcgatgttctttgcaaaccaactttctagtattcggacattttcttttgtaaaccggtgtcctctgtaaggtttagtacttttgtttatcatatcttgagttaccacattaaataccaacccatccgccgatttatttttctgtgtaagttgataattacttctatcgttttctatgctgcgcatttctttgagtaatacagtaatggtagtagtgagttgagatgttgtttgcaacaacttcttctcctcatcactaatcttacggtttttgttggccctagataagaatcctaatatatcccttaattcaacttcttcttctgttgttacactctctggtaacttaggtaaattacagcaaatagaaaagagctttttatttatgtctagtatgctggatttaaactcatctgtgatttgtggatttaaaaggtctttaatgggtattttattcattttttcttgcttatcttcctttttttcttgcccacttctaagctgatttcaatctctcctttatatatatttttaagttccaacattttatgtttcaaaacattaatgatgtctgggttttgtttgggatgcaatttattgcttcccaatgtagaaaagtacatcatatgaaacaacttaaactcttaactacttcttttaaccttcactttttatgaaatgtatcaaccatatataataacttaatagacgacattcacaatatgtttacttcgaagcctgctttcaaaattaagaacaaagcatccaaatcatacagaaacacagcggtttcaaaaaagctgaaagaaaaacgtctagctgagcatgtgaggccaagctgcttcaatattattcgaccactcaagaaagatatccagattcctgttccttcctctcgatttttaaataaaatccaaattcacaggatagcgtctggaagtcaaaatactcagtttcgacagttcaataagacatctataaaatcttcaaagaaatatttaaactcatttatggcttttagagcatattactcacagtttggctccggtgtaaaacaaaatgtcttgtcttctctgctcgctgaagaatggcacgcggacaaaatgcagcacggaatatgggactacttcgcgcaacagtataattttataaaccctggttttggttttgtagagtggttgacgaataattatgctgaagtacgtggtgacggatattgggaagatgtgtttgtacatttggccttatagagtgtggtcgtggcggaggttgtttatctttcgagtactgaatgttgtcagtatagctatcctatttgaaactccccatcgtcttgctcttgttcccaatgtttgtttatacactcatatggctatacccttatctacttgcctcttttgtttatgtctatgtatttgtataaaatatgatattactcagactcaagcaaacaatcaatgctcacacgcggccagggggagcctcgacactagtaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaaatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataggtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatcttaacttctcgaggagctccgctcgtccaacgccggcggacctcggaggttgtttatctttcgagtactgaatgttgtcagtatagctatcctatttgaaactccccatcgtcttgctcttgttcccaatgtttgtttatacactcatatggctatacccttatctacttgcctcttttgtttatgtctatgtatttgtataaaatatgatattactcagactcaagcaaacaatcaattcttagcatcattctttgttcttatcttaaccataaacgatcttgatgtgacttttgtaatttgaacgaattggctatacgggacggatgacaaatgcaccattactctaggttgttgttggatcttaacaaaccgtaaaggtaaactgcccatgcggttcacatgacttttgactttcctttgtttgctagttaccttcggcttcacaatttgtttttccacttttctaacaggtttatcacctttcaaacttatctttatcttattcgccttcttgggtgcctccacagtagaggttacttcctttttaatatgtacttttaggatactttcacgctttataaca

SEQ ID NO: 156 - DNA, 4856 bp, Saccharomyces cerevisiae
tgggataggatagtagcaactcttggaggagagcattgtcagttgtccagtctctgaagttaagtagtaagtttgcggagtcaaagggggatggcttttgccatttgtgagagttgtgcggcagcatcttattcaaatagagctgtattctgaagacctcttgtagaacatcatccatactaaaaagtaaatcgtcctgtcccattacgagctgtattagtgctgtgaccctctgtatatttacgttgccatgaagaaggtaatgggcgatattttgatacaattcctgagttgcatgttggattgagtttacgaagggtcgccagacggccagaaacctccaggcggagttaacaactagtaatacggcatccatgtttgcatcagcgccgagcctataccagtcactgagtagacgttttcttgctctttttatgtcctgacttcttttgacgagggggcattctctagagacacaggcagttgcttccagcaactgccgtacggccgttctcatgctgtcgaggattttttttgggacgatattgtcattatagggcagtgtgtgacttatgaattgttgtagaaggacgtctgtgatgttggagatatgtattttgttaactcttcttgagacgatttggccctggatagcgaagcgtgcggttacaaataggtcgtcttgttcaagaaggtaggcgaggacattatctatcagtacaaacatcttagtagtgtctgaggagagggttgattgtttatgtatttttgcgaaatatatatatatatattctacacagatatatacatatttgtttttcgggctcattctttcttctttgccagaggctcaccgctcaagaggtccgctaattctggagcgattgttattgttttttcttttcttcttctattcgaaacccagtttttgatttgaatgcgagataaactggtattcttcattagattctctaggcccttggtatctagatatgggttctcgatgttctttgcaaaccaactttctagtattcggacattttcttttgtaaaccggtgtcctctgtaaggtttagtacttttgtttatcatatcttgagttaccacattaaataccaacccatccgccgatttatttttctgtgtaagttgataattacttctatcgttttctatgctgcgcatttctttgagtaatacagtaatggtagtagtgagttgagatgttgtttgcaacaacttcttctcctcatcactaatcttacggtttttgttggccctagataagaatcctaatatatcccttaattcaacttcttcttctgttgttacactctctggtaacttaggtaaattacagcaaatagaaaagagctttttattcttgatttttgttctttcggggaaactgtataaaacttccaaaaaggaaaagtaaaacaatacatctccttatatcaaagaaaatcaagaaggacaacatggatgatatttgtagtatggcggaaaacataaacagaactctgtttaacattctaggtactgagattgatgaaatcaatctcaatactaataatctttataatgtatgttttcatttcaaggatagcctttgaatcaatttactaacaatacttcagtttataatggaaagtaatttgactaaagtagagcaacatacattacacaaaaatatttctaacaataggttagaaatataccaccacattaaaaaagagaagagcccaaagggaaaatcatcaatatcaccccaagcacgggcatttttagaacaggtttttagaagaaagcaaagccttaattccaaggaaaaagaagaagttgcaaagaaatgtggcattactccacttcaagtaagagtttgggtatgtaatatgagaatcaaacttaaatatatcctatactaacaatttgtagttcataaataaacgtatgagatctaaataaattcgttttcaatgattaaaatagcatagtcgggtttttcttttagtttcagctttccgcaacagtataattttataaaccctggttttggttttgtagagtggttgacgaataattatgctgaagtacgtggtgacggatattgggaagatgtgtttgtacatttggccttatagagtgtggtcgtggcggaggttgtttatctttcgagtactgaatgttgtcagtatagctatcctatttgaaactccccatcgtcttgctcttgttcccaatgtttgtttatacactcatatggctatacccttatctacttgcctcttttgtttatgtctatgtatttgtataaaatatgatattactcagactcaagcaaacaatcaatgctcacacgcggccagggggagcctcgacactagtaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaaatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataggtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatcttaacttctcgaggagctccgctcgtccaacgccggcggacctcggaggttgtttatctttcgagtactgaatgttgtcagtatagctatcctatttgaaactccccatcgtcttgctcttgttcccaatgtttgtttatacactcatatggctatacccttatctacttgcctcttttgtttatgtctatgtatttgtataaaatatgatattactcagactcaagcaaacaatcaattcttagcatcattctttgttcttatcttaaccataaacgatcttgatgtgacttttgtaatttgaacgaattggctatacgggacggatgacaaatgcaccattactctaggttgttgttggatcttaacaaaccgtaaaggtaaactgcccatgcggttcacatgacttttgactttcctttgtttgctagttaccttcggcttcacaatttgtttttccacttttctaacaggtttatcacctttcaaacttatctttatcttattcgccttcttgggtgcctccacagtagaggttacttcctttttaatatgtacttttaggatactttcacgctttataaca

What is claimed:

1. A method of generating a genetically modified diploid yeast cell that is sporulation and endogenous mating impaired, the method comprising:
    (a) transforming each of a first genetically modified haploid yeast cell and a second genetically modified haploid yeast cell with at least one plasmid encoding a protein capable of complementing an endogenous mating impairment of said first and second genetically modified haploid yeast cells,
    wherein said first genetically modified haploid yeast cell is sporulation and endogenous mating impaired and comprises a chromosomally integrated heterologous nucleotide sequence encoding a protein of interest, and wherein said second genetically modified haploid yeast cell is sporulation and endogenous mating impaired, is of the opposite mating type as the first genetically modified haploid yeast cell, and comprises a chromosomally integrated heterologous nucleotide sequence encoding said protein of interest;
    (b) mating the first genetically modified haploid yeast cell with the second genetically modified haploid yeast cell, thereby forming a genetically modified diploid yeast cell; and,
    (c) eliminating the one or more plasmids from the genetically modified diploid yeast cell,
    wherein the resulting genetically modified diploid yeast cell is sporulation and endogenous mating impaired and comprises two copies of a chromosomally integrated heterologous nucleotide sequence encoding said protein of interest.

2. The method of claim 1, wherein the first genetically modified haploid yeast cell and the second genetically modified haploid yeast cell are endogenous mating impaired due to a functional disruption of at least one pheromone response gene.

3. The method of claim 2, wherein step (a) comprises transforming each of the first and second genetically modified haploid yeast cells with at least one plasmid encoding a functional copy of the at least one pheromone response gene that is functionally disrupted in said first and second genetically modified haploid yeast cells.

4. The method of claim 2, wherein the pheromone response gene is selected from the group consisting of STE5, STE4, STE18, STE12, STE7, and STE11.

5. The method of claim 3, wherein the pheromone response gene is selected from the group consisting of STE5, STE4, STE18, STE12, STE7, and STE11.

6. The method of claim 2, wherein the pheromone response gene is STE5.

7. The method of claim 3, wherein the pheromone response gene is STE5.

8. The method of claim 1, wherein the first genetically modified haploid yeast cell and the second genetically modified haploid yeast cell are sporulation impaired due to a functional disruption of at least one sporulation gene.

9. The method of claim 8, wherein the sporulation gene is selected from the group consisting of IME1, IME2, NDT80, SPO11, SPO20, AMA1, HOP2, and SPO21.

10. The method of claim 9, wherein the sporulation gene is IME1.

11. The method of claim 1, wherein the second genetically modified haploid yeast cell is obtained by inducing a mating type switch in a population of the first genetically modified haploid yeast cell.

12. The method of claim 11, wherein the population of the first genetically modified haploid yeast cell is heterothallic (ho) and is induced to switch mating type by transforming the first genetically modified haploid yeast cell with a recombinant plasmid encoding a functional homothallism (HO) protein, wherein expression of the HO protein is capable of inducing a mating type switch of said first genetically modified haploid yeast cell.

13. The method of claim 1, wherein the genetically modified diploid yeast cell is a *Saccharomyces cerevisiae* cell of the Baker's yeast, IZ-1904, TA, BG-1, CR-1, SA-1, M-26, Y-904, PE-2, PE-5, VR-1, BR-1, BR-2, ME-2, VR-2, MA-3, MA-4, CAT-1, CB-1, NR-1, BT-1 or AL-1 strain.

14. The method of claim 13, wherein the *Saccharomyces cerevisiae* cell is of the PE-2 strain.

15. The method of claim 13, wherein the *Saccharomyces cerevisiae* cell is of the CAT-1 strain.

16. A method for generating a sporulation and endogenous mating impaired genetically modified heterothallic (ho) diploid yeast cell, the method comprising:
    (a) transforming a population of a first genetically modified heterothallic haploid yeast cell with a plasmid encoding a functional homothallism (HO) protein to yield a first genetically modified haploid yeast cell, wherein expression of the HO protein is capable of inducing a mating-type switch of the first genetically modified haploid yeast cell, whereby a second genetically modified haploid yeast cell of the opposite mating type as the first genetically modified haploid yeast cell is obtained,
    wherein the first genetically modified heterothallic haploid yeast cell comprises a chromosomally integrated heterologous nucleotide sequence encoding a protein of interest and functional disruptions in the STE5 gene and the IME1 gene;
    (b) transforming each of the first and the second genetically modified haploid yeast cells with a plasmid encoding a STE5 protein, whereby said transforming results in mating of the first genetically modified haploid yeast cell with the second genetically modified haploid yeast cell, thereby forming a genetically modified diploid yeast cell; and,
    (c) eliminating any plasmids from the genetically modified diploid yeast cell to yield a genetically modified heterothallic diploid yeast cell,
    wherein the resulting genetically modified heterothallic diploid yeast cell is sporulation and endogenous mating impaired and comprises two copies of a chromosomally integrated heterologous nucleotide sequence encoding said protein of interest.

17. The method of claim 16, wherein the sporulation and endogenous mating impaired heterothallic (ho) diploid yeast cell is a *Saccharomyces cerevisiae* cell of the Baker's yeast, Mauri, Santa Fe, IZ-1904, TA, BG-1, CR-1, SA-1, M-26, Y-904, PE-2, PE-5, VR-1, BR-1, BR-2, ME-2, VR-2, MA-3, MA-4, CAT-1, CB-1, NR-1, BT-1 or AL-1 strain.

18. The method of claim 17, wherein the *Saccharomyces cerevisiae* cell is of the PE-2 strain or CAT-1 strain.

* * * * *